US008541208B1

(12) United States Patent
Plesch et al.

(10) Patent No.: US 8,541,208 B1
(45) Date of Patent: Sep. 24, 2013

(54) PROCESS FOR THE PRODUCTION OF FINE CHEMICALS

(75) Inventors: Gunnar Plesch, Potsdam (DE); Piotr Puzio, Berlin (DE); Astrid Blau, Stahnsdorf (DE); Ralf Looser, Berlin (DE); Birgit Wendel, Berlin (DE); Beate Kamlage, Berlin (DE); Oliver Schmitz, Dallgow-Döberitz (DE)

(73) Assignee: Metanomics GmbH, Berlin (DE)

( * ) Notice: Subject to any disclaimer, the term of this patent is extended or adjusted under 35 U.S.C. 154(b) by 1696 days.

(21) Appl. No.: 11/644,015

(22) Filed: Dec. 21, 2006

Related U.S. Application Data

(63) Continuation-in-part of application No. PCT/EP2005/007080, filed on Jun. 29, 2005, and a continuation-in-part of application No. PCT/EP2005/013673, filed on Dec. 19, 2005.

(60) Provisional application No. 60/801,017, filed on May 17, 2006.

(30) Foreign Application Priority Data

| Jul. 2, 2004 | (EP) | 04015608 |
|---|---|---|
| Jul. 15, 2004 | (EP) | 04016615 |
| Aug. 5, 2004 | (EP) | 04018543 |
| Aug. 23, 2004 | (EP) | 04105689 |
| Aug. 27, 2004 | (EP) | 04105535 |
| Nov. 3, 2004 | (EP) | 04026007 |
| Nov. 3, 2004 | (EP) | 04026008 |
| Nov. 4, 2004 | (EP) | 04026056 |
| Nov. 4, 2004 | (EP) | 04026057 |
| Dec. 3, 2004 | (EP) | 04028670 |
| Dec. 3, 2004 | (EP) | 04028671 |
| Dec. 17, 2004 | (EP) | 04106931 |
| Dec. 18, 2004 | (EP) | 04030100 |
| Dec. 18, 2004 | (EP) | 04030101 |
| Dec. 22, 2004 | (EP) | 04030391 |
| Dec. 23, 2004 | (EP) | 04107024 |
| Dec. 28, 2004 | (EP) | 04107025 |
| Jan. 10, 2005 | (EP) | 05100166 |
| Jan. 26, 2005 | (EP) | 05100704 |
| Mar. 14, 2005 | (EP) | 05101970 |
| Apr. 20, 2005 | (EP) | 05103164 |
| Apr. 22, 2005 | (EP) | 05103283 |
| Apr. 22, 2005 | (EP) | 05103449 |
| Apr. 22, 2005 | (EP) | 05103455 |
| Apr. 27, 2005 | (EP) | 05103428 |
| May 25, 2005 | (EP) | 05104479 |
| May 25, 2005 | (EP) | 05104496 |
| May 27, 2005 | (EP) | 05104781 |
| May 30, 2005 | (EP) | 05104630 |
| Jun. 1, 2005 | (EP) | 05104761 |
| Jun. 2, 2005 | (EP) | 05104811 |
| Jun. 2, 2005 | (EP) | 05104818 |
| Jun. 3, 2005 | (EP) | 05104874 |
| Jun. 6, 2005 | (EP) | 05105001 |
| Jun. 8, 2005 | (EP) | 05105021 |
| Jun. 8, 2005 | (EP) | 05105028 |
| Jun. 10, 2005 | (EP) | 05105345 |
| Jun. 13, 2005 | (EP) | 05105136 |
| Jun. 17, 2005 | (EP) | 05105401 |
| Jun. 17, 2005 | (EP) | 05105405 |
| Jun. 17, 2005 | (EP) | 05105406 |
| Jun. 21, 2005 | (EP) | 05105508 |
| Jun. 21, 2005 | (EP) | 05105510 |
| Jun. 22, 2005 | (EP) | 05105570 |
| Jun. 22, 2005 | (EP) | 05105571 |
| Jun. 22, 2005 | (EP) | 05105575 |
| Jun. 23, 2005 | (EP) | 05105624 |
| Jun. 23, 2005 | (EP) | 05105643 |
| Jun. 27, 2005 | (EP) | 05105992 |
| Jun. 27, 2005 | (EP) | 05105993 |

(51) Int. Cl.
*C12P 13/04* (2006.01)
*C12P 13/22* (2006.01)
*C12P 13/14* (2006.01)
*C12P 13/08* (2006.01)

(52) U.S. Cl.
USPC ............ 435/106; 435/108; 435/110; 435/115

(58) Field of Classification Search
None
See application file for complete search history.

(56) References Cited

U.S. PATENT DOCUMENTS

| 5,942,660 A | 8/1999 | Gruys et al. |
|---|---|---|
| 6,750,379 B2 | 6/2004 | McElroy et al. |
| 2003/0088886 A1 | 5/2003 | Falco et al. |
| 2003/0162267 A1 | 8/2003 | Pompejus et al. |
| 2003/0188343 A1 | 10/2003 | Bowen et al. |

(Continued)

FOREIGN PATENT DOCUMENTS

| CA | 2 385 875 A1 | 4/2001 |
|---|---|---|
| EP | 0 798 377 A2 | 10/1997 |

(Continued)

OTHER PUBLICATIONS

Kappel et al. (Current Opinion in Biotechnology 3:548-553, 1992.*
Cameron (Molecular Biotechnology 7:253-265, 1997.*
Houdebine (Journal of Biotechnology 98:145-160, 2002.*
Extended European Search Report for EP 09 15 6646 dated Dec. 9, 2009.

(Continued)

*Primary Examiner* — Robert Mondesi
*Assistant Examiner* — Md. Younus Meah
(74) *Attorney, Agent, or Firm* — Novak Druce Connolly Bove + Quigg LLP

(57) ABSTRACT

The present invention relates to a process for the production of fine chemicals in a microorganism, a plant cell, a plant, a plant tissue or in one or more parts thereof. The present invention relates further to a process for the control of the production of fine chemicals in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

26 Claims, 9 Drawing Sheets

(56) References Cited

U.S. PATENT DOCUMENTS

| | | |
|---|---|---|
| 2003/0233675 A1 | 12/2003 | Cao et al. |
| 2004/0031072 A1 | 2/2004 | La Rosa et al. |
| 2006/0137043 A1 | 6/2006 | Puzio et al. |

FOREIGN PATENT DOCUMENTS

| | | | |
|---|---|---|---|
| EP | 1 033 405 A2 | | 9/2000 |
| EP | 1 375 655 A1 | | 1/2004 |
| WO | WO 96/38574 A1 | | 12/1996 |
| WO | WO-99/27106 A1 | | 6/1999 |
| WO | WO-01/07601 A2 | | 2/2001 |
| WO | WO-01/25457 A2 | | 4/2001 |
| WO | WO0175067 | * | 10/2001 |
| WO | WO-2004/035798 A2 | | 4/2004 |
| WO | WO-2004/052085 A1 | | 6/2004 |
| WO | WO 2004/092398 A2 | | 10/2004 |

OTHER PUBLICATIONS

Blattner, F.R., et al., "The Complete Genome Sequence of *Escherichia coil* K-12", Science, vol. 277, (1997), pp. 1453-1474.

Nair, R. B., et al., "The *Arabidopsis thaliana* Reduced Epidermal Fluorescence1 Gene Encodes an Aldehyde Dehydrogenase Involved in Ferulic Acid and Sinapic Acid Biosynthesis", The Plant Cell, (2004), vol. 16, pp. 544-554.

Kuninaka, A., "Nucleotides and Related Compounds", Biotechnology, (1996), vol. 6, Chapter 15, pp. 501-612.

Eggersdorfer, M., et al., "Vitamins", Ullmann's Encyclopedia of Industrial Chemistry, Fifth Completely Revised Edition, (1996), vol. A27, pp. 443-613.

Schomburg, F, M., et al., "Overexpression of a Novel Class of Gibberellin 2-Oxidases Decreases Gibberellin Levels and Creates Dwarf Plants", The Plant Cell, (2003), vol. 15, pp. 151-163.

"*Arabidopsis thaliana* protein fragment SEQ ID No: 6299", EBI Database, Accession No. AAG08669, Oct. 17, 2000.

"Thale cress protein upregulated in E2Fa/Dpa expressing plants SeqID 1226", EBI Database, Accession No. ADN73331, Jul. 15, 2004.

"Plant growth associated protein Seq ID 54", Database EBI, Accession No. ADE25079, Jan. 29, 2004.

Azevedo, R.A., et al., "The Aspartic Acid Metabolic Pathway, an Exciting and Essential Pathway in Plants", Amino Acids, vol. 30, No. 2, (2006), pp. 143-162.

Goffeau, A., et al., "Life with 6000 Genes", Science, vol. 274, (1996), pp. 546, 563-567.

"Protein YFR007W", Database UniProt, Accession No. P43591, Nov. 1, 1955.

Lee, P.C., et al., "Metabolic Engineering Towards Biotechnological Production of Carotenoids in Microorganisms", Appl. Microbiol. Biotechnol., vol. 60, (2002), pp. 1-11.

"Uncharacterized protein YFR007W", UniProt Database Accession No. P43591, Nov. 1, 1995.

Dietrich, et al., "The *Ashbya gossypii* Genome as a Tool for Mapping the Ancient *Saccharomyces cerevisiae* Genome", Science, vol. 304, (2004) pp. 304-307.

"STP4 protein", Database Uniprot Accession No. Q07351, Nov. 1, 1996.

"Stp3p", Database Uniprot Accession No. Q05937, Nov. 1, 1996.

*S.cerevisiae* chromosome XV reading frame ORF YOR084w (YOR084W) (YOR protein), Database UniProt Accession No. Q12405, Nov. 1, 1996.

"AFR588Wp", Database UniProt Accession No. Q75217, Jul. 5, 2004.

Johnston, M. et al., "The Nucleotide Sequence of *Saccharomyces cerevisiae* Chromosome XII", Nature, vol. 387, Supp., 1997, pp. 87-90.

Voss, H. et al., "DNA Sequencing and Analysis of 130 kb from Yeast Chromosome XV", Yeast, vol. 13, (1997) pp. 655-672.

"AltName: Full=GMP Synthetase", Database Uniprot Accession No. P38625, Oct. 1, 1994. XP002580004.

"*S. cerevisiae* GUA1 gene for GMP synthase", Database EMBL Accession No. X70397, Mar. 11, 1994. XP002580005.

"RecName: Full=GMP synthase [glutamine-hydrolyzing]", Database Uniprot Accession No. P04079, Nov. 1, 1986. XP002580006.

Hashimoto, S-I., et al., "Whole Microbial Cell Processes for Manufacturing Amino Acids, Vitamins or Ribonucleotides", Current Opinion in Biotechnology, vol. 10, No. 6, (1999), pp. 604-608.

Tiedeman, A., et al., "Nucleotide Sequence of the *guaA* Gene Encoding GMP Synthetase of *Escherichia coli* K12", The Journal of Biological Chemistry, vol. 260, No. 15, (1985), pp. 8676-8679.

European Search Report EP09179273, dated Apr. 29, 2010.

Yamada, M., et al., Characterization of the *gcd* Gene from *Escherichia coil* K-12 W3110 and Regulation of Its Expression, Journal of Bacteriology, vol. 175, No. 2, (1993), pp. 568-571.

Partial European Search Report EP 09 15 6897 dated May 4, 2010.

Gu, K.F., et al., "Conversion of Ammonia or Urea into L-Leucine, L-Valine, and L-Isoleucine Using Artifical Cells Containing an Immobilized Multienzyme System and Dextran-NAD", Trans Am. Soc. Artif Intern Organs, vol. 34, (1988), pp. 24-28.

\* cited by examiner

Figure 4A

EG073qcz (Seq ID No: 68240)
gtttacccgccaatatatcctgtcaaacactgatagtttgtggaattcgagctcggtacccggggatcctctagagtcgacctgcaggca
tgcaagctttgcagtgcagcgtgaccggtcgtgcccctctctagagataatgagcattgcatgtctaagttataaaaaattaccacatat
tttttttgtcacacttgtttgaagtgcagtttatctatctttatacatatatttaaactttactctacgaataatataatctatagtactacaataatat
cagtgttttagagaatcatataaatgaacagttagacatggtctaaaggacaattgagtattttgacaacaggactctacagtttatcttttt
agtgtgcatgtgttctcctttttttttgcaaatagcttcacctatataatacttcatccatttattagtacatccatttaggggtttagggttaatggttt
ttatagactaatttttttagtacatctattttattctatttttagcctctaaattaagaaaactaaaactctattttagtttttttatttaatagtttagatat
aaaatagaataaaataaagtgactaaaaattaaacaaatacccttaagaaattaaaaaaactaaggaaacattttcttgtttcgagt
agataatgccagcctgttaaacgccgtcgacgagtctaacggacaccaaccagcgaaccagcagcgtcgcgtcgggccaagcga
agcagacggcacggcatctctgtcgctgcctctggacccctctcgagagttccgctccaccgttggacttgctccgctgtcggcatcca
gaaattgcgtggcggagcggcagacgtgagccggcacggcaggcggcctcctcctcctcacggcaccggcagctacggggga
ttcctttcccaccgctccttcgctttcccttcctcgcccgccgtaataaatagacacccctccacaccctctttccccaacctcgtgttgttc
ggagcgcacacacacacaaccagatctcccccaaatccacccgtcggcacctccgcttcaaggtacgccgctcgtcctcccccccc
cccccctctctaccttctctagatcggcgttccggtccatggttagggcccggtagttctacttctgttcatgtttgtgttagatccgtgtttgtg
ttagatccgtgctgctagcgttcgtacacggatgcgacctgtacgtcagacacgttctgattgctaacttgccagtgtttctctttggggaat
cctgggatggctctagccgttccgcagacgggatcgattcatgatttttttttgtttcgttgcatagggtttggtttgcccttttcctttatttcaatat
atgccgtgcacttgttgtcgggtcatcttttcatgcttttttttgtcttggttgtgatgatgtggtctggttgggcggtcgttctagatcggagtaga
atctgtttcaaactacctggtggatttattaattttggatctgtatgtgtgtgccatacatattcatagttacgaattgaagatgatggatggaa
atatcgatctaggataggtatacatgttgatgcgggttttactgatgcatatacagagatgcttttgttcgcttggttgtgatgatgtggtgtgg
ttgggcggtcgttcattcgttctagatcggagtagaatactgttcaaactacctggtgtatttattaattttggaactgtatgtgtgtgtcatac
atcttcatagttacgagtttaagatggatggaaatatcgatctaggataggtatacatgttgatgtgggttttactgatgcatatacatgatg
gcatatgcagcatcattcatatgctctaaccttgagtacctatctattataataaacaagtatgtttataattatttcgatcttgatatacttgg
atgatgcatatgcagcagctatatgtggattttttagccctgccttcatacgctatttatttgcttggtactgtttctttgtcgatgctcaccctg
ttgtttggtgttacttctgcagggtacccccggggatccactagttctagaaaccatggccaccgccgccgccgcgtctaccgcgctcac
tggcgccactaccgctgcgcccaaggcgaggcgccgggcgcacctcctggccacccgccgcgccctcgccgcgcccatcaggtg
ctcagcggcgtcacccgccatgccgatggctcccccggccaccccgctccggccgtgggccccaccgatccccgcaagggcgc
cgacatcctcgtcgagtccctcgagcgctgcggcgtccgcgacgtcttcgcctaccccggcggcgcgtccatggagatccaccaggc
actcacccgctcccccgtcatcgccaaccacctcttccgccacgagcaaggggaggccttttgcggcctccggctacgcgcgctcctc
gggccgcgtcggcgtcgcatcgccacctccggccccggcgccaccaaccttgtctccgcgctcgccgacgcgctgctcgattccgtc
cccatggtcgccatcacgggacaggtgccgcgacgcatgattggcaccgacgccttccaggagacgcccatcgtcgaggtcaccc
gctccatcaccaagcacaactacctggtcctcgacgtcgacgacatcccccgcgtcgtgcaggaggctttcttcctcgcctcctctggtc
gaccggggccggtgcttgtcgacatccccaaggacatccagcagcagatggcggtgcctgtctgggacaagcccatgagtctgcct
gggtacattgcgcgccttcccaagccccctgcgactgagttgcttgagcaggtgctgcgtcttgttggtgaatccggcgccctgttcttta
tgttggcggtggctgcgcagcatctggtgaggagttgcgacgctttgtggagctgactggaatcccggtcacaactactcttatgggcct
cggcaacttccccagcgacgacccactgtctctgcgcatgctaggtatgcatggcacggtgtatgcaaattatgcagtggataaggcc
gatctgttgcttgcacttggtgtgcggtttgatgatcgtgtgacagggaagattgaggcttttgcaagcagggctaagattgtgcacgttga
tattgatccggctgagattggcaagaacaagcagccacatgtgtccatctgtgcagatgttaagcttgctttgcagggcatgaatgctctt
cttgaaggaagcacatcaaagaagagctttgactttggctcatggaacgatgagttggatcagcagaagagggaattcccccttgggt
ataaaacatctaatgaggagatccagccacaatatgctattcaggttcttgatgagctgacgaaaggcgaggccatcatcggcacag
gtgttgggcagcaccagatgtgggcggcacagtactacacttacaagcggccaaggcagtggttgtcttcagctggtcttggggctatg
ggatttggtttgccggctgctgctggtgcttctgtggccaacccaggtgttactgttgttgacatcgatggagatggtagcttctcatgaac
gttcaggagctagctatgatccgaattgagaacctcccggtgaaggtctttgtgctaaacaaccagcacctggggatggtggtgcagt
gggaggacaggttctataaggccaacagagcgcacacatacttgggaaacccagagaatgaaagtgagatatatccagatttcgtg
acgatcgccaaaggggttcaacattccagcggtccgtgtgacaaagaagaacgaagtccgcgcagcgataaagaagatgctcgag
actccagggccgtacctcttggatataatcgtcccacaccaggagcatgtgttgcctatgatccctaatggtggggctttcaaggatatg
atcctggatggtgatggcaggactgtgtactgatctaaaatccagcaagcaactgatctaaaatccagcaagcaccgctccctgcta
gtacaagggtgatatgttttatctgtgtgatgttctcctgtattctatcttttttgtaggccgtcagctatctgttatggtaatcctatgtagcttcc
gaccttgtaattgtgtagtctgttgttttccttctggcatgtgtcataagagatcatttaagtgccttttgctacatataaataagataataagca
ctgctatgcagtggttctgaattggctctgttgccaaatttaagtgtccaactggtccttgcttttgttttcgctatttttttcctttttttagttattattat
attggtaaattcaactcaacatatgatgtatggaataatgctagggctgcaatttcaaactattttacaaaccagaatggcattttcgtggttt
gagggggagtgaaaaaaaatgaggcatttgactgaattagttacctgatccattttcgtggtttggatcattggaattaaattccattctaata
atagtaatttggcatatatcaattaagttaattcggtttttatgcaaaatatatttgtatactattattatcaagatgtcggagatatttatatgcta
cattttttactatacaggagtgagatgaagagtgtcatgtaagttacacagtagaaacaaattctattaatgcataaaatcatttccatcatc
cacccctatgaatttgagatagacctatatctaaacttttgaaaagtggttgaatatcaaattccaaattaaataagttattttattgagtgaatt
ctaatttctctaaaacgaagggatctaaacgccctctaaagctaatttggaaactcaaactttcttagcattggaggggattgagaaaaa

Figure 4B atattaattcattttcatctcaatcattcaatctccaaagagatttgagttccttattagtctgttccatgcatcaaatcggctcaatgtgtcattat
ttgccatgacgattgacgagttgttctggggcctagcgctttccacgccgatgtgctggggcctggtcctggagaagacagcttgatattt
aaagctatcaattgtttcaattgattcccacttcattttctaaatgtagaaaacggtgacgtataagaaaaagaatgaattaggacttttatt
ccgtacactaatctagagcggccccttaaggcgctgcgatcgcgttaacagcttgctgaggaggcctcggaccgttaattaacacgtg
ggcgcgccactagtcaattcagtacattaaaaacgtccgcaatgtgttattaagttgtctaagcgtcaatttgtttacaccacaatatatcct
gccaccagccagccaacagctccccgaccggcagctcggcacaaaatcaccactcgatacaggcagcccatcagtccgggacg
gcgtcagcgggagagccgttgtaaggcggcagactttgctcatgttaccgatgctattcggaagaacggcaactaagctgccgggttt
gaaacacggatgatctcgcggagggtagcatgttgattgtaacgatgacagagcgttgctgcctgtgatcaaatatcatctccctcgca
gagatccgaattatcagccttcttattcatttctcgcttaaccgtgacaggctgtcgatcttgagaactatgccgacataataggaaatcgc
tggatataagccgctgaggaagctgagtggcgctatttctttagaagtgaacgttgacgatcgtcgaccgtaccccgatgaattaattcg
gacgtacgttctgaacacagctggatacttacttgggcgattgtcatacatgacatcaacaatgtacccgtttgtgtaaccgtctcttggag
gttcgtatgacactagtggttcccctcagcttgcgactagatgttgaggcctaacattttattagagagcaggctagttgcttagatacatg
atcttcaggccgttatctgtcagggcaagcgaaaattggccatttatgacgaccaatgccccgcagaagctcccatctttgccgccata
gacgccgcgccccctttggggtgtagaacatcctttgccagatgtggaaaagaagttcgttgtcccattgttggcaatgacgtagtag
ccggcgaaagtgcgagacccatttgcgctatatataagcctacgatttccgttgcgactattgtcgtaattggatgaactattatcgtagtt
gctctcagagttgtcgtaatttgatggactattgtcgtaattgcttatggagttgtcgtagttgcttggagaaatgtcgtagttggatggggagt
agtcataggggaagacgagcttcatccactaaaacaattggcaggtcagcaagtgcctgccccgatgccatcgcaagtacgaggctt
agaaccaccttcaacagatcgcgcatagtcttccccagctctctaacgcttgagttaagccgcgccgcgaagcggcgtcggcttgaac
gaattgttagacattatttgccgactaccttggtgatctcgcctttcacgtagtgaacaaattcttccaactgatctgcgcgcgaggccaag
cgatcttcttgtccaagataagcctgcctagcttcaagtatgacgggctgatactgggccggcaggcgctccattgcccagtcggcagc
gacatccttcggcgcgattttgccggttactgcgctgtaccaaatgcgggacaacgtaagcactacattcgctcatcgccagcccagt
cgggcggcgagttccatagcgttaaggtttcatttagcgcctcaaatagatcctgttcaggaaccggatcaaagagttcctccgccgct
ggacctaccaaggcaacgctatgttctcttgcttttgtcagcaagatagccagatcaatgtcgatcgtggctggctcgaagatacctgca
agaatgtcattgcgctgccattctccaaattgcagttcgcgcttagctggataacgccacggaatgatgtcgtcgtgcacaacaatggtg
acttctacagcgcggagaatctcgctctctccaggggaagccgaagtttccaaaaggtcgttgatcaaagctcgccgcgttgtttcatca
agccttacggtcaccgtaaccagcaaatcaatatcactgtgtggcttcaggccgccatccactgcggagccgtacaaatgtacggcc
agcaacgtcggttcgagatggcgctcgatgacgccaactacctctgatagttgagtcgatacttcggcgatcaccgcttccctcatgatg
tttaactcctgaattaagccgcgccgcgaagcggtgtcggcttgaatgaattgttaggcgtcatcctgtgctcccgagaaccagtacca
gtacatcgctgtttcgttcgagacttgaggtctagttttatacgtgaacaggtcaatgccgccgagagtaaagccacattttgcgtacaaa
ttgcaggcaggtacattgttcgtttgtgtctctaatcgtatgccaaggagctgtctgcttagtgcccacttttttcgcaaattcgatgagactgtg
cgcgactcctttgcctcggtgcgtgtgcgacacaacaatgtgttcgatagaggctagatcgttccatgttgagttgagttcaatcttcccga
caagctcttggtcgatgaatgcgccatagcaagcagagtcttcatcagagtcatcatccgagatgtaatccttccggtaggggctcaca
cttctggtagatagttcaaagccttggtcggataggtgcacatcgaacacttcacgaacaatgaaatggtctcagcatccaatgtttccg
ccacctgctcagggatcaccgaaatcttcatatgacgcctaacgcctggcacagcggatcgcaaacctggcgcggcttttggcacaa
aaggcgtgacaggtttgcgaatccgttgctgccacttgttaacccttttgccagatttggtaactataatttatgttagaggcgaagtcttgg
gtaaaaactggcctaaaattgctggggatttcaggaaagtaaacatcaccttccggctcgatgtctattgtagatatatgtagtgtatctac
ttgatcgggggatctgctgcctcgcgcgttcggtgatgacggtgaaaacctctgacacatgcagctcccggagacggtcacagcttgt
ctgtaagcggatgccgggagcagacaagcccgtcagggcgcgtcagcgggtgttggcgggtgtcggggcgcagccatgacccag
tcacgtagcgatagcggagtgtatactggcttaactatgcggcatcagagcagattgtactgagagtgcaccatatgcggtgtgaaata
ccgcacagatgcgtaaggagaaaataccgcatcaggcgctcttccgcttcctcgctcactgactcgctgcgctcggtcgttcggctgcg
gcgagcggtatcagctcactcaaaggcggtaatacggttatccacagaatcaggggataacgcaggaaagaacatgtgagcaaa
aggccagcaaaaggccaggaaccgtaaaaaggccgcgttgctggcgttttccataggctccgcccccctgacgagcatcacaaa
aatcgacgctcaagtcagaggtggcgaaacccgacaggactataaagataccaggcgtttccccctggaagctccctcgtgcgctct
cctgttccgaccctgccgcttaccggatacctgtccgcctttctcccttcgggaagcgtggcgctttctcatagctcacgctgtaggtatctc
agttcggtgtaggtcgttcgctccaagctgggctgtgtgcacgaaccccccgttcagcccgaccgctgcgccttatccggtaactatcgt
cttgagtccaacccggtaagacacgacttatcgccactggcagcagccactggtaacaggattagcagagcgaggtatgtaggcgg
tgctacagagttcttgaagtggtggcctaactacggctacactagaaggacagtatttggtatctgcgctctgctgaagccagttaccttc
ggaaaaagagttggtagctcttgatccggcaaacaaaccaccgctggtagcggtggtttttttgtttgcaagcagcagattacgcgcag
aaaaaaaggatctcaagaagatcctttgatcttttctacggggtctgacgctcagtggaacgaaaactcacgttaagggattttggtcat
gagattatcaaaaaggatcttcacctagatccttttaaattaaaaatgaagttttaaatcaatctaaagtatatatgagtaaacttggtctga
cagttaccaatgcttaatcagtgaggcacctatctcagcgatctgtctatttcgttcatccatagttgcctgactccccgtcgtgtagataact
acgatacgggagggcttaccatctggccccagtgctgcaatgataccgcgagacccacgctcaccggctccagatttatcagcaata
aaccagccagccggaagggccgagcgcagaagtggtcctgcaactttatccgcctccatccagtctattaattgttgccgggaagcta
gagtaagtagttcgccagttaatagtttgcgcaacgttgttgccattgctgcagggggggggggggggggggacttccattgttcattcc
acggacaaaaacagagaaaggaaacgacagaggccaaaaagcctcgctttcagcacctgtcgtttcctttctttcagagggtatttta
aataaaaacattaagttatgacgaagaagaacggaaacgccttaaaccggaaaattttcataaatagcgaaaacccgcgaggtcg

Figure 4C ccgccccgtaacctgtcggatcaccggaaaggacccgtaaagtgataatgattatcatctacatatcacaacgtgcgtggaggccatc
aaaccacgtcaaataatcaattatgacgcaggtatcgtattaattgatctgcatcaacttaacgtaaaaacaacttcagacaatacaaa
tcagcgacactgaatacggggcaacctcatgtcccccccccccccccccctgcaggcatcgtggtgtcacgctcgtcgtttggtatggc
ttcattcagctccggttcccaacgatcaaggcgagttacatgatcccccatgttgtgcaaaaaagcggttagctccttcggtcctccgatc
gttgtcagaagtaagttggccgcagtgttatcactcatggttatggcagcactgcataattctcttactgtcatgccatccgtaagatgctttt
ctgtgactggtgagtactcaaccaagtcattctgagaatagtgtatgcggcgaccgagttgctcttgcccggcgtcaacacgggataat
accgcgccacatagcagaactttaaaagtgctcatcattggaaaacgttcttcggggcgaaaactctcaaggatcttaccgctgttgag
atccagttcgatgtaacccactcgtgcacccaactgatcttcagcatcttttactttcaccagcgtttctgggtgagcaaaaacaggaagg
caaaatgccgcaaaaaagggaataagggcgacacggaaatgttgaatactcatactcttccttttttcaatattattgaagcatttatcag
ggttattgtctcatgagcggatacatatttgaatgtatttagaaaaataaacaaatagggggttccgcgcacatttccccgaaaagtgcca
cctgacgtctaagaaaccattattatcatgacattaacctataaaaataggcgtatcacgaggcccttcgtcttcaagaattggtcgacg
atcttgctgcgttcggatattttcgtggagttcccgccacagaccccggattgaaggcgagatccagcaactcgcgcagatcatcctgtg
acggaactttggcgcgtgatgactggccaggacgtcggccgaaagagcgacaagcagatcacgcttttcgacagcgtcggatttgc
gatcgaggattttcggcgctgcgctacgtccgcgaccgcgttgagggatcaagccacagcagcccactcgaccttctagccgaccc
agacgagccaagggatcttttggaatgctgctccgtcgtcaggctttccgacgtttgggtggttgaacagaagtcattatcgtacggaat
gccaagcactcccgaggggaaccctgtggttggcatgcacatacaaatggacgaacggataaaccttttcacgccctttaaatatcc
gttattctaataaacgctcttttctcttag >EG065qcz (Seq ID No: 68241)
acacaggaaacagctatgaccatgattacgccaagctatcgtttaaaccttaaggcgatcgcgctgaggcggaccgcacgtggaatt
agcttggcgcgccaattcccgatctagtaacatagatgacaccgcgcgcgataatttatctagtttgcgcgctatattttgttttctatcgc
gtattaaatgtataattgcgggactctaatcataaaaacccatctcataaataacgtcatgcattacatgttaattattacatgcttaacgta
attcaacagaaattatatgataatcatcgcaagaccggcaacaggattcaatcttaagaaactttattgccaaatgtttgaacgatcggg
gaaattcgagctccaccgcggtggcggccgctctagaactagtggatcccccgggctgcaggaattcgatatcaagcttatcgatacc
gtcgacctcgagggggggcccggtaccttggtgaactaccgatgatcgtaagagcttacagacggtgccttatataggcagagcgtc
ggaagggggtggtgtcacacacgcactgcgatccttgcttacaagctaagcaaaggcatcgtggcagacaaggaataaagtggc
acaggtgccaaaagaaagtggacagcacacttgtccgaaaagcacacaataatacaactcagtggagcatccactgaatgggcc
cagtactctccgctgcggtcatccctgacgtcaatgcctcctcaatcgtcattgcttacgtcttggagatctagcacatcttctgcggctact
ggcgacatagcccttggtgtggcctggtattcctcgaactcctgctcttctatcttcagcttggtgacttccttcataagttcctcctccattgttt
gcacgccaccggtcttcagaacttcaagattcttgagaaattcatcaattctgtcttgaatgtgttcttcaatgagatctgcccagtaccag
caatggcatttgttcattgcgcacttgaagaatttccttcctgggttggcagatgttctggacactaactgaattgcaggcttcctgcatgca
cagagtagaactggttcctctgttagcataaaagcttgctctgttcttcgaacatgtccttcttgaatgtggggaatggatccagaattttgtt
tccccattctctgagttgctcagtgtatggatgatctggataaggaattacttcccttatggcttgtgtaagcaggatcatctcttccgttggtc
attctgagctaatttggctttgagcctggacaagatgtcagctaaaccattgctcttccctttatgtgttcaatgactatctctggtcctgcac
cagtgatgtagtccatgaacctgatccatctgatctcagaaggcttgtgttcagcactcttgttgtagaaccttttcgattgcactactgtcagt
tctgactgtgatctctcttttgtccaagtagaacaatctcatcttttctaagccattcataaccccatagatttctgcatcacaggtccttttggc
ttatcaaattttccactggcatacctacagatttgctctgtatttcttgggtctgccttgttttcttccacttgcatactgctcccccatccagttgca
catgcatctgtttcaatgataatgtatgcatcttcggtggaatagtgagatttggaagcgttctcaccattgtcttgatcctattgatcagcttc
caatcttctgaattgagccttcgctcacctttctctgaggtctttggatataatgggccaagaagcttgcccatatctttgatgtggttctggc
atagttcagtgttgctagccaggattaattaaaggcctgttaacagcgctgggcccgataattcactggccgtcgtttacaacgtcgtga
ctgggaaaaccctggcgttacccaacttaatcgccttgcagcacatccccctttcgccagctggcgtaatagcgaagaggcccgcac
cgatcgcccttcccaacagttgcgcagcctgaatggcgaatggcgcctgatgcggtatttttctccttacgcatctgtgcggtatttcacac
cgcatatggtgcactctcagtacaatctgctctgatgccgcatagttaagccagccccgacacccgccaacacccgctgacgcgccct
gacggcttgtctgctcccggcatccgcttacagacaagctgtgaccgtctccgggagctgcatgtgtcagaggttttcaccgtcatcac
cgaaacgcgcgagacgaaagggcctcgtgatacgcctatttttataggttaatgtcatgataataatggtttcttagacgtcaggtggca
cttttcggggaaatgtgcgcggaacccctatttgtttatttttctaaatacattcaaatatgtatccgctcatgagacaataaccctgataaat
gcttcaataatattgaaaaaggaagagtatgagtattcaacatttccgtgtcgcccttattccctttttgcggcattttgccttcctgttttgctc
acccagaaacgctggtgaaagtaaaagatgctgaagatcagttgggtgcacgagtgggttacatcgaactggatctcaacagcggt
aagatccttgagagttttcgccccgaagaacgttttccaatgatgagcacttttaaagttctgctatgtggcgcggtattatcccgtattgac
gccgggcaagagcaactcggtcgccgcatacactattctcagaatgacttggttgagtactcaccagtcacagaaaagcatcttacg
gatggcatgacagtaagagaattatgcagtgctgccataaccatgagtgataacactgcggccaacttacttctgacaacgatcgga
ggaccgaaggagctaaccgcttttttgcacaacatgggggatcatgtaactcgccttgatcgttgggaaccggagctgaatgaagcca
taccaaacgacgagcgtgacaccacgatgcctgtagcaatggcaacaacgttgcgcaaactattaactggcgaactacttactctag
cttcccggcaacaattaatagactggatggaggcggataaagttgcaggaccacttctgcgctcggcccttccggctggctgtttattg
ctgataaatctggagccggtgagcgtgggtctcgcggtatcattgcagcactggggccagatggtaagccctcccgtatcgtagttatct
acacgacggggagtcaggcaactatgatgaacgaaatagacagatcgctgagataggtgcctcactgattaagcattggtaactgt

Figure 4D cagaccaagtttactcatatatactttagattgatttaaaacttcatttttaatttaaaaggatctaggtgaagatcctttttgataatctcatga
ccaaaatcccttaacgtgagttttcgttccactgagcgtcagacccgtagaaaagatcaaaggatcttcttgagatcctttttttctgcgc
gtaatctgctgcttgcaaacaaaaaaaccaccgctaccagcggtggtttgtttgccggatcaagagctaccaactcttttccgaaggta
actggcttcagcagagcgcagataccaaatactgttcttctagtgtagccgtagttaggccaccacttcaagaactctgtagcaccgcct
acatacctcgctctgctaatcctgttaccagtggctgctgccagtggcgataagtcgtgtcttaccgggttggactcaagacgatagttac
cggataaggcgcagcggtcgggctgaacggggggttcgtgcacacagcccagcttggagcgaacgacctacaccgaactgagat
acctacagcgtgagctatgagaaagcgccacgcttcccgaagggagaaaggcggacaggtatccggtaagcggcagggtcgga
acaggagagcgcacgagggagcttccaggggggaaacgcctggtatctttatagtcctgtcgggtttcgccacctctgacttgagcgtc
gattttgtgatgctcgtcaggggggcggagcctatggaaaaacgccagcaacgcggcctttttacggttcctggccttttgctggccttt
gctcacatgttctttcctgcgttatcccctgattctgtggataaccgtattaccgcctttgagtgagctgataccgctcgccgcagccgaac
gaccgagcgcagcgagtcagtgagcgaggaagcggaagagcgcccaatacgcaaaccgcctctccccgcgcgttggccgattc
attaatgcagctggcacgacaggtttcccgactggaaagcgggcagtgagcgcaacgcaattaatgtgagttagctcactcattaggc
accccaggctttacactttatgcttccggctcgtatgttgtgtggaattgtgagcggataacaatttc >pMME0607 (Seq ID No: 68242)
gtttacccgccaatatatcctgtcaaacactgatagtttgtggaattcgagctcggtacccggggatcctctagagtcgacctgcaggca
tgcaagcttccggctgcagtgcagcgtgacccggtcgtgccctctctagagataatgagcattgcatgtctaagttataaaaaattacc
acatatttttttgtcacacttgttgaagtgcagtttatctatctttatacatatatttaaactttactctacgaataatataatctatagtactacaa
taatatcagtgttttagagaatcatataaatgaacagttagacatggtctaaaggacaattgagtatttgacaacaggactctacagtttt
atcttttttagtgtgcatgtgttctccttttttttttgcaaatagcttcacctatataatacttcatccatttttattagtacatccatttagggtttagggtta
atggttttttatagactaattttttttagtacatctatttttattctattttagcctctaaattaagaaaactaaaactctatttttagttttttttatttaatagttt
agatataaaatagaataaaataaagtgactaaaaattaaacaaatacccctttaagaaattaaaaaaaactaaggaaacattttcttgttt
cgagtagataatgccagcctgttaaacgccgtcgacgagtctaacggacaccaaccagcgaaccagcagcgtcgcgtcgggcca
agcgaagcagacggcacggcatctctgtcgctgcctctggacccctctcgagagttccgctccaccgttggacttgctccgctgtcggc
atccagaaattgcgtggcggagcggcagacgtgagccggcacggcaggcggcctcctcctcctctcacggcaccggcagctacgg
gggattcctttcccaccgctccttcgcttcccttcctcgcccgccgtaataaatagacaccccctccacaccctctttccccaacctcgtgt
tgttcggagcgcacacacacacaaccagatctcccccaaatccacccgtcggcacctccgcttcaaggtacgccgctcgtcctcccc
cccccccccctctctacctctctagatcggcgttccggtccatggttagggcccggtagttctacttctgttcatgttgtgttagatccgtgt
ttgtgttagatccgtgctgctagcgttcgtacacggatgcgacctgtacgtcagacacgttctgattgctaacttgccagtgttctctttggg
gaatcctgggatggctctagccgttccgcagacgggatcgatttcatgatttttttttgtttcgttgcatagggtttggtttgcccttttcctttatttc
aatatatgccgtgcacttgtttgtcgggtcatcttttcatgcttttttttgtcttggttgtgatgatgtggtctggttgggcggtcgttctagatcgga
gtagaattctgtttcaaactacctggtgatttattaattttggatctgtatgtgtgtgccatacatattcatagttacgaattgaagatgatgga
tggaaatatcgatctaggataggtatacatgttgatgcgggttttactgatgcatatacagagatgcttttgttcgcttggttgtgatgatgtg
gtgtggttgggcggtcgttcattcgttctagatcggagtagaatactgtttcaaactacctggtgtatttattaattttggaactgtatgtgtgtgt
catacatcttcatagttacgagtttaagatggatggaaatatcgatctaggataggtatacatgttgatgtgggttttactgatgcatatacat
gatggcatatgcagcatctattcatatgctctaaccttgagtacctatctattataataaacaagtatgtttataattatttcgatcttgatatac
ttggatgatggcatatgcagcagctatatgtggatttttttagccctgccttcatacgctattatttgcttggtactgttctttgtcgatgctcac
cctgttgtttggtgttacttctgcagggtaccccggggatcctactagttctagaaaccatggccaccgccgccgccgcgtctaccgcgc
tcactggcgccactaccgctgcgcccaaggcgaggcgccgggcgcacctcctggccaccgccgcgccctcgccgcgcccatca
ggtgctcagcggcgtcacccgccatgccgatggctccccggccacccgctccgccgtggggcccaccgatccccgcaaggg
cgccgacatcctcgtcgagtccctcgagcgctgcggcgtccgcgacgtcttcgcctaccccggcggcgcgtccatggagatccacca
ggcactcacccgctcccccgtcatcgccaaccacctcttccgccacgagcaaggggaggccttttgcgggcctccggctacgcgcgctc
ctcgggccgcgtcggcgtctgcatcgccacctccggccccggcgccaccaaccttgtctccgcgctcgccgacgcgctgctcgattcc
gtccccatggtcgccatcacgggacaggtgccgcgacgcatgattggcaccgacgccttccaggagacgccatcgtcgaggtcac
ccgctccatcaccaagcacaactacctggtcctcgacgtcgacgacatcccccgcgtcgtgcaggaggcttcttcctcgcctcctctg
gtcgaccggggccggtgcttgtcgacatccccaaggacatccagcagcagatggcggtgcctgtctgggacaagcccatgagtctg
cctgggtacattgcgcgccttcccaagcccctgcgactgagttgcttgagcaggtgctgcgtcttgttggtgaatcccggcgcctgttct
ttatgttggcggtggctgcgcagcatctggtgaggagttgcgacgctttgtggagctgactggaatcccggtcacaactactcttatgggc
ctcggcaacttcccagcgacgacccactgtctgcgcatgctaggtatgcatggcacggtgtatgcaaattatgcagtggataaggc
cgatctgttgcttgcacttggtgtgccggtttgatgatcgtgtgacagggaagattgaggcttttgcaagcagggctaagattgtgcacgttg
atattgatccggctgagattggcaagaacaagcagccacatgtgtccatctgtgcagatgttaagcttgctttgcagggcatgaatgctc
ttcttgaaggaagcacatcaaagaagagctttgacttggctcatgaacgatgagttggatcagcagaagagggaattcccccttgg
gtataaaacatctaatgaggagatccagccacaatatgctattcaggttcttgatgagctgacgaaaggcgaggccatcatcggcac
aggtgttgggcagcaccagatgtgggcggcacagtactacacttacaagcggccaaggcagtggttgtcttcagctggtcttggggct
atgggatttggtttgccggctgctgctggtgcttctgtggccaacccaggtgttactgttgttgacatcgatggagatggtagctttctcatga

Figure 4E acgttcaggagctagctatgatccgaattgagaacctcccggtgaaggtcttgtgctaaacaaccagcacctggggatggtggtgca
gtgggaggacaggttctataaggccaacagagcgcacacatacttgggaaacccagagaatgaaagtgagatatatccagatttcg
tgacgatcgccaaagggttcaacattccagcggtccgtgtgacaaagaagaacgaagtccgcgcagcgataaagaagatgctcga
gactccagggccgtacctcttggatataatcgtcccacaccaggagcatgtgttgcctatgatccctaatggtgggcttcaaggatat
gatcctggatggtgatggcaggactgtgtactgatctaaaatccagcaagcaactgatctaaaatccagcaagcaccgcctccctgct
agtacaagggtgatatgttttatctgtgtgatgttctcctgtattctatctttttttgtaggccgtcagctatctgttatggtaatcctatgtagcttc
cgaccttgtaattgtgtagtctgttgttttccttctggcatgtgtcataagagatcatttaagtgcctttgctacatataaataagataataagc
actgctatgcagtggttctgaattggcttctgttgccaaatttaagtgtccaactggtccttgcttttgtttttcgctatttttttccttttttagttattatt
atattggtaatttcaactcaacatatgatgtatggaataatgctagggctgcaatttcaaactattttacaaaccagaatggcatttcgtgg
tttgaggggagtgaaaaaaaatgaggcatttgactgaattagttacctgatccatttcgtggtttggatcattggaattaaattccattctaa
taatagtaattttggcatatatcaattaagttaattcggtttatgcaaaatatatttgtatactattattatcaagatgtcggagatatttatatgc
tacattttactatacaggagtgagatgaagagtgtcatgtaagttacacagtagaaacaaattctattaatgcataaaatcatttccatca
tccaccctatgaatttgagatagacctatatctaaactttgaaaagtggttgaatatcaaattccaaattaaataagttattttattgagtgaa
ttctaatttctctaaaacgaagggatctaaacgccctctaaagctaatttggaaactcaaactttcttagcattggaggggattgagaaaa
aatattaattcattttcatctcaatcattcaatctccaaagagatttgagttccttattagtctgttccatgcatcaaatcggctcaatgtgtcatt
atttgccatgacgattgacgagttgttctggggcctagcgctttccacgccgatgtgctggggcctggtcctggagaagacagcttgatat
ttaaagctatcaattgtttcaattgattcccacttcatttttctaaatgtagaaaacggtgacgtataagaaaaagaatgaattaggactttta
ttccgtacactaatctagagcggccccttaaggcgctgcgatcgcgttaacagcttgctgaggaggcctcggaccgttaattaatcctgg
ctagcaacactgaactatgccagaaaccacatcaaagatatgggcaagcttcttggcccattatatccaaagacctcagagaaaggt
gagcgaaggctcaattcagaagattggaagctgatcaataggatcaagacaatggtgagaacgcttccaaatctcactattccacca
gaagatgcatacattatcattgaaacagatgcatgtgcaactggatggggagcagtatgcaagtggaagaaaaacaaggcagacc
caagaaatacagagcaaatctgtaggtatgccagtggaaaatttgataagccaaaaggaacctgtgatgcagaaatctatgggtta
tgaatggcttagaaaagatgagattgttctacttggacaaaagagagatcacagtcagaactgacagtagtgcaatcgaaaggttcta
caacaagagtgctgaacacaagccttctgagatcagatggatcaggttcatggactacatcactggtgcaggaccagagatagtcat
tgaacacataaaagggaagagcaatggtttagctgacatcttgtccaggctcaaagccaaattagctcagaatgaaccaacggaag
agatgatcctgcttacacaagccataagggaagtaattccttatccagatcatccatacactgagcaactcagagaatggggaaaca
aaattctggatccattccccacattcaagaaggacatgttcgaaagaacagagcaagcttttatgctaacagaggaaccagttctactc
tgtgcatgcaggaagcctgcaattcagttagtgtccagaacatctgccaacccaggaaggaaattcttcaagtgcgcaatgaacaaat
gccattgctggtactgggcagatctcattgaagaacacattcaagacagaattgatgaatttctcaagaatcttgaagttctgaagaccg
gtggcgtgcaaacaatggaggaggaacttatgaaggaagtcaccaagctgaagatagaagagcaggagttcgaggaataccag
gccacaccaagggctatgtcgccagtagccgcagaagatgtgctagatctccaagacgtaagcaatgacgattgaggaggcattga
cgtcagggatgaccgcagcggagagtactgggcccattcagtggatgctccactgagttgtattattgtgtgcttttcggacaagtgtgct
gtccactttcttttggcacctgtgccactttattccttgtctgccacgatgcctttgcttagcttgtaagcaaggatcgcagtgcgtgtgtgaca
ccacccccttccgacgctctgcctatataaggcaccgtctgtaagctcttacgatcatcggtagttcaccaaggtacgcccggtcgct
cctacgcgtcaatgatccgcggacgccgagcccgagctcgaatttccccgatcgttcaaacatttggcaataaagtttcttaagattgaa
tcctgttgccggtcttgcgatgattatcatataatttctgttgaattacgttaagcatgtaataattaacatgtaatgcatgacgttatttatgag
atgggttttatgattagagtcccgcaattatacatttaatacgcgatagaaaacaaaatatagcgcgcaaactaggataaaattatcgcg
cgcggtgtcatctatgttactagatcgggaattggcgcgccactagtcaattcagtacattaaaaacgtccgcaatgtgttattaagttgtc
taagcgtcaatttgtttacaccacaatatatcctgccaccagccagccaacagctccccgaccggcagctcggcacaaaatcaccac
tcgatacaggcagcccatcagtccgggacggcgtcagcgggagagccgttgtaaggcggcagactttgctcatgttaccgatgctatt
cggaagaacggcaactaagctgccgggtttgaaacacggatgatctcgcggagggtagcatgttgattgtaacgatgacagagcgtt
gctgcctgtgatcaaatatcatctccctcgcagagatccgaattatcagccttcttattcatttctgcttaaccgtgacaggctgtcgatctt
gagaactatgccgacataataggaaatcgctggataaagccgctgaggaagctgagtggcgctatttctttagaagtgaacgttgacg
atcgtcgaccgtaccccgatgaattaattcggacgtacgttctgaacacagctggatacttacttgggcgattgtcatacatgacatcaa
caatgtacccgtttgtgtaaccgtctcttggaggttcgtatgacactagtggttcccctcagcttgcgactagatgttgaggcctaacattta
ttagagagcaggctagttgcttagatacatgatcttcaggccgttatctgtcagggcaagcgaaaattggccatttatgacgaccaatgc
cccgcagaagctcccatctttgccgccatagacgccgcgcccccttttgggggtgtagaacatccttttgccagatgtggaaaagaagt
tcgttgtcccattgttggcaatgacgtagtagccggcgaaagtgcgagacccatttgcgctatatataagcctacgatttccgttgcgact
attgtcgtaattggatgaactattatcgtagttgctctcagagttgtcgtaatttgatggactattgtcgtaattgcttatggagttgtcgtagttg
cttggagaaatgtcgtagttggatggggagtagtcataggaagacgagcttcatccactaaaacaattggcaggtcagcaagtgcct
gccccgatgccatcgcaagtacgaggcttagaaccaccttcaacagatcgcgcatagtcttccccagctctctaacgcttgagttaagc
cgcgccgcgaagcggcgtcggcttgaacgaattgttagacattatttgccgactacctggtgatctcgcctttcacgtagtgaacaaatt
cttccaactgatctgcgcgcgaggccaagcgatcttcttgtccaagataagcctgcctagcttcaagtatgacgggctgatactgggcc
ggcaggcgctccattgcccagtcggcagcgacatccttcggcgcgattttgccggttactgcgctgtaccaaatgcgggacaacgtaa
gcactacatttcgctcatcgccagcccagtcgggcggcgagttccatagcgttaaggtttcatttagcgcctcaaatagatcctgttcagg
aaccggatcaaagagttcctccgccgctggacctaccaaggcaacgctatgttctcttgcttttgtcagcaagatagccagatcaatgtc

Figure 4F gatcgtggctggctcgaagatacctgcaagaatgtcattgcgctgccattctccaaattgcagttcgcgcttagctggataacgccacg
gaatgatgtcgtcgtgcacaacaatggtgacttctacagcgcggagaatctcgctctctccaggggaagccgaagtttccaaaaggtc
gttgatcaaagctcgccgcgttgtttcatcaagccttacggtcaccgtaaccagcaaatcaatatcactgtgtggcttcaggccgccatc
cactgcggagccgtacaaatgtacggccagcaacgtcggttcgagatggcgctcgatgacgccaactacctctgatagttgagtcga
tacttcggcgatcaccgcttccctcatgatgtttaactctgaattaagccgcgccgcgaagcggtgtcggcttgaatgaattgttaggcg
tcatcctgtgctcccgagaaccagtaccagtacatcgctgtttcgttcgagacttgaggtctagttttatacgtgaacaggtcaatgccgcc
gagagtaaagccacattttgcgtacaaattgcaggcaggtacattgttcgtttgtgtctctaatcgtatgccaaggagctgtctgcttagtg
cccacttttcgcaaattcgatgagactgtgcgcgactcctttgcctcggtgcgtgtgcgacacaacaatgtgttcgatagaggctagatc
gttccatgttgagttgagttcaatcttcccgacaagctcttggtcgatgaatgcgccatagcaagcagagtcttcatcagagtcatcatcc
gagatgtaatccttccggtagggggctcacacttctggtagatagttcaaagccttggtcggataggtgcacatcgaacacttcacgaac
aatgaaatggttctcagcatccaatgtttccgccacctgctcagggatcaccgaaatcttcatatgacgcctaacgcctggcacagcgg
atcgcaaacctggcgcggcttttggcacaaaaggcgtgacaggtttgcgaatccgttgctgccacttgttaacccttttgccagatttggt
aactataatttatgttagaggcgaagtcttgggtaaaaactggcctaaaattgctggggatttcaggaaagtaaacatcaccttccggct
cgatgtctattgtagatatatgtagtgtatctacttgatcgggggatctgctgcctcgcgcgtttcggtgatgacggtgaaaacctctgaca
catgcagctcccggagacggtcacagcttgtctgtaagcggatgccgggagcagacaagcccgtcagggcgcgtcagcgggtgtt
ggcgggtgtcggggcgcagccatgacccagtcacgtagcgatagcggagtgtatactggcttaactatgcggcatcagagcagattg
tactgagagtgcaccatatgcggtgtgaaataccgcacagatgcgtaaggagaaaataccgcatcaggcgctcttccgcttcctcgct
cactgactcgctgcgctcggtcgttcggctgcggcgagcggtatcagctcactcaaaggcggtaatacggttatccacagaatcaggg
gataacgcaggaaagaacatgtgagcaaaaggccagcaaaaggccaggaaccgtaaaaaggccgcgttgctggcgtttttccat
aggctccgcccccctgacgagcatcacaaaaatcgacgctcaagtcagaggtggcgaaacccgacaggactataaagataccag
gcgtttccccctggaagctccctcgtgcgctctcctgttccgaccctgccgcttaccggatacctgtccgcctttctcccttcgggaagcgt
ggcgctttctcatagctcacgctgtaggtatctcagttcggtgtaggtcgttcgctccaagctgggctgtgtgcacgaaccccccgttcag
cccgaccgctgcgccttatccggtaactatcgtcttgagtccaacccggtaagacacgacttatcgccactggcagcagccactggta
acaggattagcagagcgaggtatgtaggcggtgctacagagttcttgaagtggtggcctaactacggctacactagaaggacagtatt
tggtatctgcgctctgctgaagccagttaccttcggaaaaagagttggtagctcttgatccggcaaacaaaccaccgctggtagcggtg
gttttttttgtttgcaagcagcagattacgcgcagaaaaaaaggatctcaagaagatcctttgatcttttctacggggtctgacgctcagtgg
aacgaaaactcacgttaagggattttggtcatgagattatcaaaaaggatcttcacctagatccttttaaattaaaaatgaagttttaaatc
aatctaaagtatatatgagtaaacttggtctgacagttaccaatgcttaatcagtgaggcacctatctcagcgatctgtctatttcgttcatcc
atagttgcctgactccccgtcgtgtagataactacgatacgggagggcttaccatctggccccagtgctgcaatgataccgcgagacc
cacgctcaccggctccagatttatcagcaataaaccagccagccggaagggccgagcgcagaagtggtcctgcaactttatccgcc
tccatccagtctattaattgttgccgggaagctagagtaagtagttcgccagttaatagtttgcgcaacgttgttgccattgctgcaggggg
gggggggggggggacttccattgttcattccacggacaaaaacagagaaaggaaacgacagaggccaaaaagcctcgctttca
gcacctgtcgtttcctttctttcagagggtattttaaataaaaacattaagttatgacgaagaagaacggaaacgccttaaaccggaaa
attttcataaatagcgaaaacccgcgaggtcgccgccccgtaacctgtcggatcaccggaaaggacccgtaaagtgataatgattat
catctacatatcacaacgtgcgtggaggccatcaaaccacgtcaaataatcaattatgacgcaggtatcgtattaattgatctgcatcaa
cttaacgtaaaaacaacttcagacaatacaaatcagcgacactgaatacggggcaacctcatgtccccccccccccccctgca
ggcatcgtggtgtcacgctcgtcgtttggtatggcttcattcagctccggttcccaacgatcaaggcgagttacatgatcccccatgttgtg
caaaaaagcggttagctccttcggtcctccgatcgttgtcagaagtaagttggccgcagtgttatcactcatggttatggcagcactgcat
aattctcttactgtcatgccatccgtaagatgcttttctgtgactggtgagtactcaaccaagtcattctgagaatagtgtatgcggcgaccg
agttgctcttgcccggcgtcaacacgggataataccgcgccacatagcagaactttaaaagtgctcatcattggaaaacgttcttcggg
gcgaaaactctcaaggatcttaccgctgttgagatccagttcgatgtaacccactcgtgcacccaactgatcttcagcatcttttactttca
ccagcgtttctgggtgagcaaaaacaggaaggcaaaatgccgcaaaaaagggaataagggcgacacggaaatgttgaatactca
tactcttcctttttcaatattattgaagcatttatcagggttattgtctcatgagcggatacatatttgaatgtatttagaaaaataaacaaatag
gggttccgcgcacatttccccgaaaagtgccacctgacgtctaagaaaccattattatcatgacattaacctataaaaataggcgtatc
acgaggccctttcgtcttcaagaattggtcgacgatcttgctgcgttcggatattttcgtggagttcccgccacagacccggattgaaggc
gagatccagcaactcgcgccagatcatcctgtgacggaactttggcgcgtgatgactggccaggacgtcggccgaaagagcgaca
agcagatcacgcttttcgacagcgtcggatttgcgatcgaggattttttcggcgctgcgctacgtccgcgaccgcgttgagggatcaagc
cacagcagcccactcgacttctagccgacccagacgagccaagggatctttttggaatgctgctccgtcgtcaggctttccgacgtttg
ggtggttgaacagaagtcattatcgtacggaatgccaagcactcccgagggggaaccctgtggttggcatgcacatacaaatggacg
aacggataaaccttttcacgccctttaaatatccgattattctaataaaacgctcttttctcttag

US 8,541,208 B1

PROCESS FOR THE PRODUCTION OF FINE CHEMICALS

RELATED APPLICATIONS

The instant application is a continuation-in-part application of International Patent Application No. PCT/EP 2005/007080, filed Jun. 29, 2005 and of International Patent Application No. PCT/EP 2005/013673, filed Dec. 19, 2005, and claims benefit to U.S. Provisional Application No. 60/801,017, filed May 17, 2006. International Patent Application No. PCT/EP 2005/007080 and International Patent Application No. PCT/EP 2005/013673 claim the benefit of European Application No. 04030101.2, filed Dec. 18, 2004, European Application No. 04106931.1, filed Dec. 17, 2005, European Application No. 04030391.9, filed Dec. 22, 2004, European Application No. 05100166.7, filed Jan. 10, 2005, European Application No. 05103449.4, filed Apr. 22, 2005, European Application No. 04107024.4, filed Dec. 23, 2004, European Application No. 04030100.4, filed Dec. 18, 2004, European Application No. 05101970.1, filed Mar. 14, 2005, European Application No. 04107025.1, filed Dec. 28, 2004, European Application No. 05104781.9, filed May 27, 2005, European Application No. 05100704.5, filed Jan. 26, 2005, European Application No. 05103283.7, filed Apr. 22, 2005, European Application No. 05103455.1, filed Apr. 22, 2005, European Application No. 05103164.9, filed Apr. 20, 2005, European Application No. 05103428.8, filed Apr. 27, 2005, European Application No. 05104479.0, filed May 25, 2005, European Application No. 05104496.4, filed May 25, 2005, European Application No. 05105001.1, filed Jun. 6, 2005, European Application No. 05104874.2, filed Jun. 3, 2005, European Application No. 05105345.2, filed Jun. 10, 2005, European Application No. 05104630.8, filed May 30, 2005, European Application No. 05104761.1, filed Jun. 1, 2005, European Application No. 05104811.4, filed Jun. 2, 2005, European Application No. 05104818.9, filed Jun. 2, 2005, European Application No. 05105021.9, filed Jun. 8, 2005, European Application No. 05105028.4, filed Jun. 8, 2005, European Application No. 05105136.5, filed Jun. 13, 2005, European Application No. 05105993.9, filed Jun. 27, 2005, European Application No. 05105508.5, filed Jun. 21, 2005, European Application No. 05105575.4, filed Jun. 22, 2005, European Application No. 05105510.1, filed Jun. 21, 2005, European Application No. 05105401.3, filed Jun. 17, 2005, European Application No. 05105405.4, filed Jun. 17, 2005, European Application No. 05105992.1, filed Jun. 27, 2005, European Application No. 05105570.5, filed Jun. 22, 2005, European Application No. 05105406.2, filed Jun. 17, 2005, European Application No. 05105624.0, filed Jun. 23, 2005, European Application No. 05105643.0, filed Jun. 23, 2005, and European Application No. 05105571.3, filed Jun. 22, 2005. Additionally, International Patent Application PCT/EP 2005/007080 also claims benefit to European Application No. 04015608.5, filed Jul. 2, 2004, European Application No. 04016615.9, filed Jul. 15, 2004, European Application No. 04018543.1, filed Aug. 5, 2004, European Application No. 04105689.6, filed Aug. 23, 2004, European Application No. 04105535.1, filed Aug. 27, 2004, European Application No. 04026008.5, filed Nov. 3, 2004, European Application No. 04026007.7, filed Nov. 3, 2004, European Application No. 04026057.2, filed Nov. 4, 2004, European Application No. 04026056.4, filed Nov. 4, 2004, European Application No. 04028670.0, filed Dec. 3, 2004, and European Application No. 04028671.8, filed Dec. 3, 2004. The entire content of the above-referenced patent applications are incorporated herein by this reference in their entirety.

The present invention relates to a process for the production of a fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

SUBMISSION ON COMPACT DISC

The contents of the following submission on compact discs are incorporated herein by reference in its entirety: two copies of the Sequence Listing (COPY 1 and COPY 2) and a computer readable form copy of the Sequence Listing (CRF COPY), all on compact disc, each containing: file name: date recorded: Dec. 20, 2006, size:. The instant application also contains lengthy Tables in electronic form in lieu of a printed paper (or .pdf) copy, and is hereby incorporated by reference in its entirety.

BRIEF DESCRIPTION OF THE DRAWINGS

FIG. 4A-F depicts the sequences of SEQ ID NO: 68240, SEQ ID NO: 68241, and SEQ ID NO: 68242.

Figure 1:
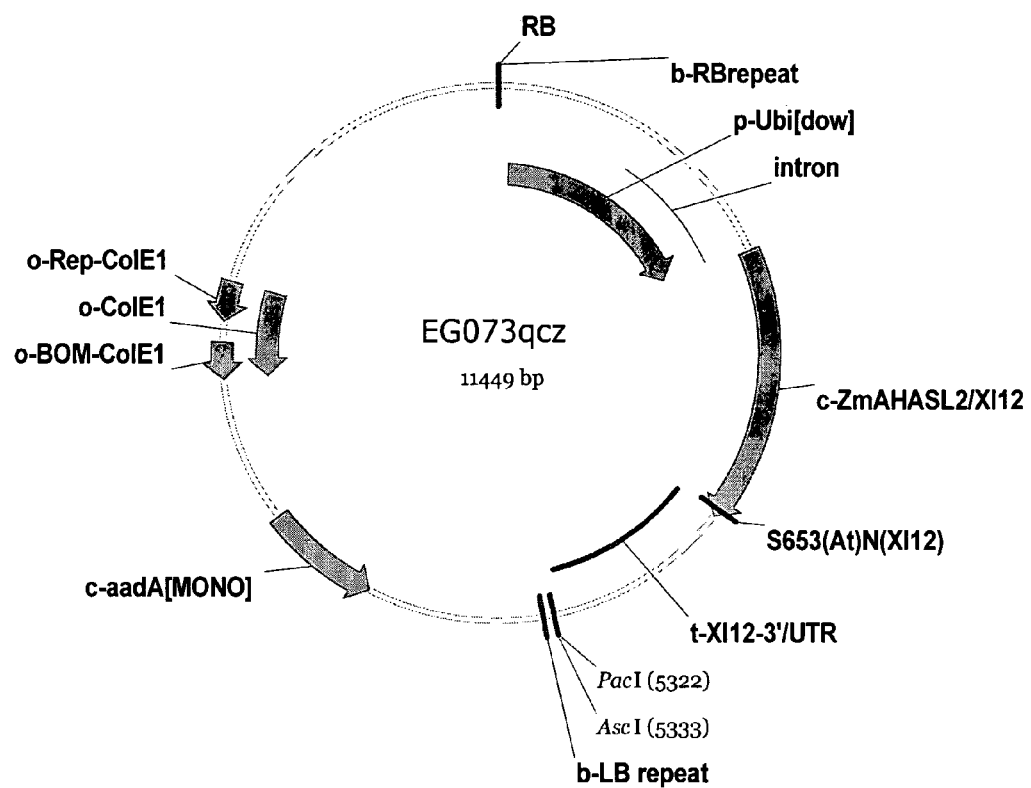
FIG. 1 depicts a vector map of vector EG073qcz (SEQ ID NO: 68240).
Figure 2:
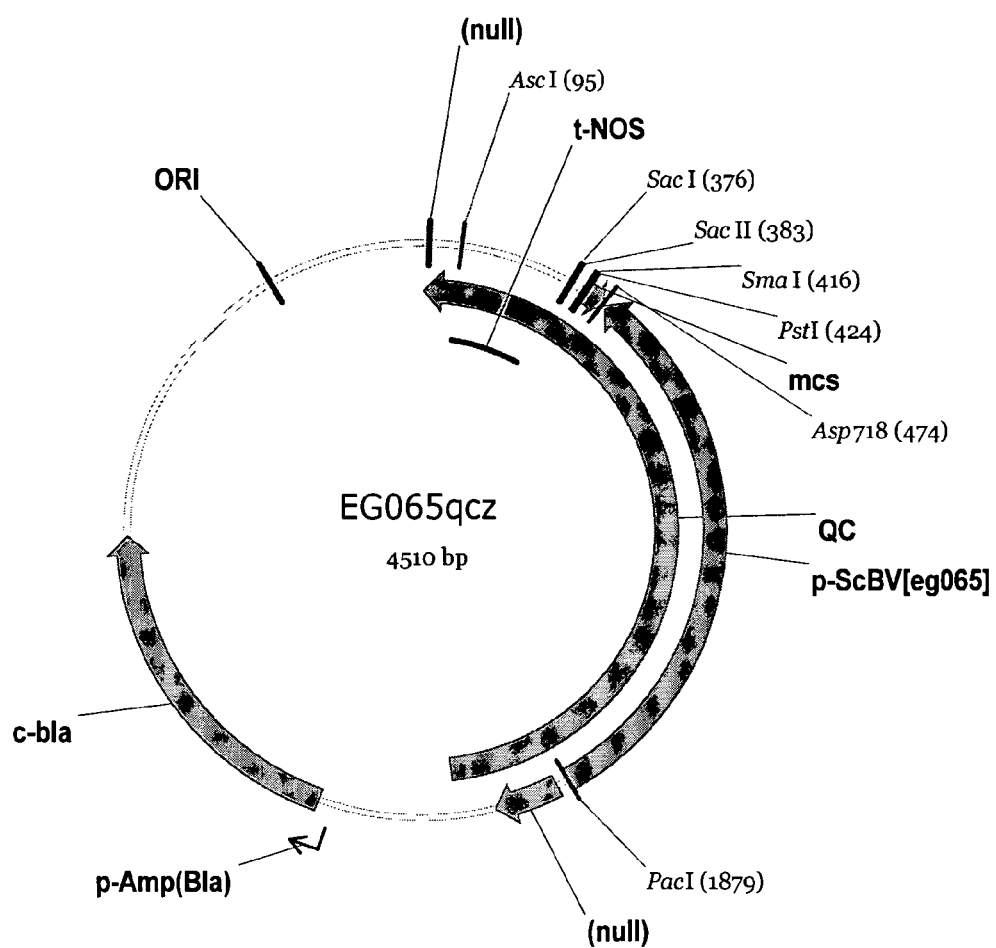
FIG. 2 depicts a vector map of vector EG065qcz (SEQ ID NO: 68241).
Figure 3:
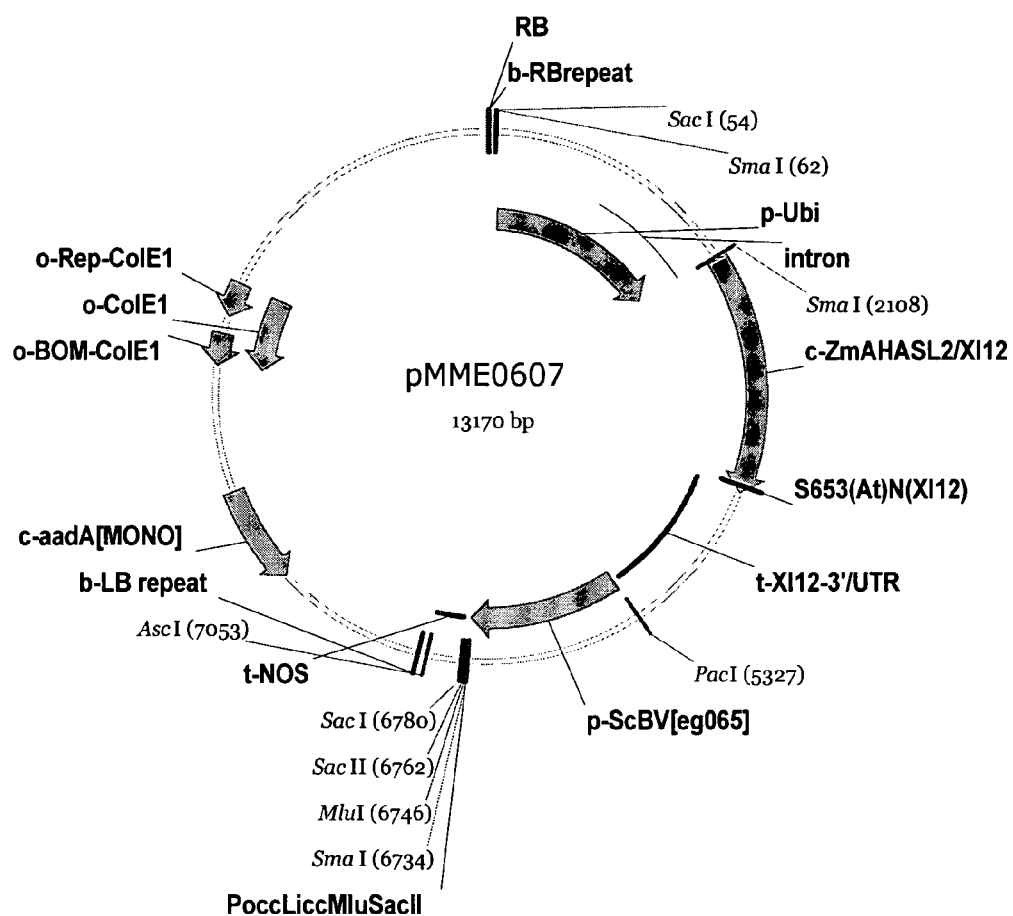
FIG. 3 depicts a vector map of the binary vector for corn transformation pMME0607 (SEQ ID NO: 68242).

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other substances described in Ullmann's Encyclopedia of Industrial Chemistry, vol. A2, pp. 57-97, VCH Weinheim, 1985.

Over one million tons of amino acids are currently produced annually; their market value amounts to over 2.5 billion US dollars. They are currently produced by four competing processes: Extraction from protein hydrolysates, for example L-cystine, L-leucine or L-tyrosine, chemical synthesis, for example of D-, L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is *Corynebacterium glutamicum*, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterized thoroughly; for a review of the bacterial amino acid biosynthesis and its regulation, see Umbarger, H. E. (1978) Ann. Rev. Biochem. 47: 533-606.

It is known that amino acids are produced by fermentation of strains of coryneform bacteria, in particular *Corynebacterium glutamicum*. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as *Escherichia* or *Bacillus* are also used for the production of amino acids. A number of mutant strains, which produce an assortment of desirable compounds from the group of the sulfur-containing fine chemicals, have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetyl-norleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082,993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases special enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenesis of plant and selection afterwards with inhibitors of certain enzymes of amino acid biosynthetic pathway.

Methods of recombinant DNA technology have also been used for some years to improve *Corynebacterium* strains producing L-amino acids by amplifying individual amino acid biosynthesis genes and investigating the effect on amino acid production.

As described above, the essential amino acids are necessary for humans and many mammals, for example for livestock. L-methionine is important as methyl group donor for the biosynthesis of, for example, choline, creatine, adrenaline, bases and RNA and DNA, histidine, and for the transmethylation following the formation of S-adenosylmethionine or as a sulfhydryl group donor for the formation of cysteine. Moreover, L-methionine appears to have a positive effect in depression.

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add a plurality of amino acids in a balanced manner to suit the organism.

It is an object of the present invention to develop an inexpensive process for the synthesis of L-methionine. L-methionine is with lysine or threonine (depending on the organism) one of the two amino acids which are most frequently limiting It was now found that this object is achieved by providing the process according to the invention described herein and the embodiments characterized in the claims.

Accordingly, in a first embodiment, the invention relates to a process for the production of a fine chemical, whereby the fine chemical is methionine Accordingly, in the present invention, the term "the fine chemical" as used herein relates to "methadone". Further, in another embodiment the term "the fine chemicals" as used herein also relates to compositions of fine chemicals comprising methionine.

In one embodiment, the term "the fine chemical" or "the respective fine chemical" means L-methionine. Throughout the specification the term "the fine chemical" or "the respective fine chemical" means methionine, preferably L-methionine, its salts, ester or amides in free form or bound to proteins. In a preferred embodiment, the term "the fine chemical" means L-methionine in free form or its salts or bound to proteins. In one embodiment, the term "the fine chemical"

and the term "the respective fine chemical" mean at least one chemical compound with an activity of the above mentioned fine chemical.

Accordingly, the present invention relates to a process comprising
(a) increasing or generating the activity of one or more YLR375W, YBL015w, YER173w, YOR084w and/or b1829 and/or b4232, b0464, b1343, b2414, and/or b2762 protein(s) or of a protein having the sequence of a polypeptide encoded by a nucleic acid molecule indicated in Table I, columns 5 or 7, lines 1 to 5 and/or lines 334 to 338 in a non-human organism or in one or more parts thereof and
(b) growing the organism under conditions which permit the production of the fine chemical, thus, methionine or a fine chemicals comprising methionine, in said organism.

Accordingly, the present invention relates to a process for the production of a fine chemical comprising
(a) increasing or generating the activity of one or more proteins having the activity of a protein indicated in Table II, column 3, lines 1 to 5 and/or lines 334 to 338 or having the sequence of a polypeptide encoded by a nucleic acid molecule indicated in Table I, column 5 or 7, lines 1 to 5 and/or lines 334 to 338, in a non-human organism in one or more parts thereof and
(b) growing the organism under conditions which permit the production of the fine chemical, in particular methionine.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

The term "Table I" used in this specification is to be taken to specify the content of Table I A and Table I B. The term "Table II" used in this specification is to be taken to specify the content of Table II A and Table II B. The term "Table I A" used in this specification is to be taken to specify the content of Table I A. The term "Table I B" used in this specification is to be taken to specify the content of Table I B. The term "Table II A" used in this specification is to be taken to specify the content of Table II A. The term "Table II B" used in this specification is to be taken to specify the content of Table II B. In one preferred embodiment, the term "Table I" means Table I B. In one preferred embodiment, the term "Table II" means Table II B.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein having the activity of a protein indicated in Table II, column 3, lines 1 to 5 and/or lines 334 to 338 or encoded by nucleic acid molecule indicated in Table I, columns 5 or 7, lines 1 to 5 and/or lines 334 to 338.

Surprisingly it was found, that the transgenic expression of at least one of the *Saccharomyces cerevisiae* protein(s) indicated in Table II, Column 3, lines 1 to 4 and/or at least one of the *Escherichia coli* K12 protein(s) indicated in Table II, Column 3, line 5 and/or lines 334 to 338 in *Arabidopsis thaliana* conferred an increase in the methionine content of the transformed plants.

In accordance with the invention, the term "organism" as understood herein relates always to a non-human organism, in particular to an animal or plant organism or to a microorganism. Further, the term "animal" as understood herein relates always to a non-human animal.

In accordance with the invention it is known to the skilled that anionic compounds such as acids are present in aqueous solutions in an equilibrium between the acid and its salts according to the pH present in the respective compartment of the cell or organism and the pK of the acid. Depending on the strength of the acid (pK) and the pH the salt or the free acid are predominant. Thus, the term "the fine chemical", the term "the respective fine chemical", or the term "acid" or the use of a denomination referring to a neutralized anionic compound relates to the anionic form as well as the neutralised status of that compound according to the milieu of the aqueous solution in which they are present.

The sequence of YLR375w from *Saccharomyces cerevisiae* has been published in Johnston, Nature 387 (6632 Suppl), 87-90, 1997, and Goffeau, Science 274 (5287), 546-547, 1996, and its activity is being "involved in pre-tRNA slicing and in uptake of branched-chain amino acids; YLR375wp". Accordingly, in one embodiment, the process of the present invention comprises the use of a gene product "involved in pre-tRNA slicing and in uptake of branched-chain amino skids" from *Saccharomyces cerevisiae* or its homolog, e.g. as shown herein, for the production of the fine chemical, meaning of methionine, in particular for increasing the amount of methionine in free or bound form in an organism or a part thereof, as mentioned.

The sequence of YBL015w from *Saccharomyces cerevisiae* has been published in Goffeau, Science 274 (5287), 546-547, 1996, and in Feldmann, EMBO J., 13, 5795-5809, 1994 and its activity is being defined as an "Mannose-containing glycoprotein which binds concanavalin A; Ach1p". In another reference, the activity is described as "acetyl-CoA hydrolase". Accordingly, in one embodiment, the process of the present invention comprises the use of a "Mannose-containing glycoprotein which binds concanavalin A; Ach1p" from *Saccharomyces cerevisiae* or its homolog, e.g. as shown herein, for the production of the fine chemical, meaning of methionin, in particular for increasing the amount of methionine in free or bound form in an organism or a part thereof, as mentioned. Accordingly, in one embodiment, the process of the present invention comprises the use of a "Acetyl-CoA hydrolase" from *Saccharomyces cerevisiae* or its homolog, e.g. as shown herein, for the production of the fine chemical, meaning of methionin, in particular for increasing the amount of methionine in free or bound form in an organism or a part thereof, as mentioned.

The sequence of YER173w from *Saccharomyces cerevisiae* has been published in Dietrich, Nature 387 (6632 Suppl), 78-81, 1997, and Goffeau, Science 274 (5287), 546-547, 1996, and its activity is being defined as an "Checkpoint protein, involved in the activation of the DNA damage and meiotic pachytene checkpoints; subunit of a clamp loader that loads Rad17p-Mec3p-Dc1p onto DNA, homolog of the human and *S. pompe* Rad17 protein; Rad24p". Accordingly, in one embodiment, the process of the present invention comprises the use of a "Checkpoint protein, involved in the activation of the DNA damage and meiotic pachytene checkpoints" or its "subunit of a clamp loader that loads Rad17p-Mec3p-Dc1p onto DNA" or a Rad24p from *Saccharomyces cerevisiae* or a Rad17 protein or its homolog, e.g. as shown herein, for the production of the fine chemical, meaning of methionin, in particular for increasing the amount of methionine in free or bound form in an organism or a part thereof, as mentioned. The sequence of YOR084w from *Saccharomyces cerevisiae* has been published in Dujon, Nature 387 (6632 Suppl), 98-102, 1997, and Goffeau, Science 274 (5287), 546-547, 1996, and its activity is being defined as a putative lipase of the peroxisomal matrix. Accordingly, in one embodiment, the process of the present invention comprises the use of a putative lipase of the peroxisomal matrix" from *Saccharomyces cerevisiae* or its homolog, e.g. as shown herein, for the production of the fine chemical, meaning of methionin, in particular for increasing the amount of methionine in free or bound form in an organism or a part thereof, as mentioned.

The sequence of b1829 from *Escherichia coli* K12 has been published in Blattner, Science 277(5331), 1453-1474, 1997, and its activity is being defined as a heat shock protein. Accordingly, in one embodiment, the process of the present invention comprises the use of a "heat shock protein" from *E. coli* or its homolog, e.g. as shown herein, for the production of the fine chemical, meaning of methionin, in particular for increasing the amount of methionine in free or bound form in an organism or a part thereof, as mentioned. In one embodiment, in the process of the present invention the activity of a htpX heat shock protein is increased or generated, e.g. from *E. coli* or a homolog thereof. Homologs are also for example the htpX heat shock protein is also annotated as having a protease activity. Accordingly, in one embodiment, in the process of the present invention the activity of a protease, preferably of a heat shock protease, more preferred of a htpX protease or its homolog is increased for the production of the fine chemical, meaning of methionin, in particular for increasing the amount of methionine in free or bound form in an organism or a part thereof, as mentioned.

The sequence of b0464 from *Escherichia coli* K12 has been published in Blattner, Science 277(5331), 1453-1474, 1997, and its activity is being defined as a "transcriptional repressor for multidrug efflux pump (TetR/AcrR family)". Accordingly, in one embodiment, the process of the present invention comprises the use of a "transcriptional repressor for multidrug efflux pump (TetR/AcrR family)" from *E. coli* or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a protein of the superfamily "probable transcription repressor mtrr", is increased or generated, preferably having activity in transcriptional control and/or DNA binding, e.g. from *E. coli* or a homolog thereof. Accordingly, in one embodiment, in the process of the present invention the activity of a "transcriptional repressor for multidrug efflux pump (TetR/AcrR family)" or its homolog is increased for the production of the fine chemical, meaning of methionine, in particular for increasing the amount of methionine in free or bound form in an organism or a part thereof, as mentioned.

The sequence of b1343 from *Escherichia coli* K12 has been published in Blattner, Science 277(5331), 1453-1474, 1997, and its activity is being defined as an ATP-dependent RNA helicase, stimulated by 23S rRNA. Accordingly, in one embodiment, the process of the present invention comprises the use of an "ATP-dependent RNA helicase, stimulated by 23S rRNA" from *E. coli* or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a protein having an activity in rRNA processing or translation is increased or generated, e.g. from *E. coli* or a homolog thereof. Accordingly, in one embodiment, in the process of the present invention the activity of a ATP-dependent RNA helicase, stimulated by 23S rRNA or its homolog is increased for the production of the fine chemical, meaning of methionine, in particular for increasing the amount of methionine in free or bound form in an organism or a part thereof, as mentioned.

The sequence of b2414 from *Escherichia coli* K12 has been published in Blattner, Science 277(5331), 1453-1474, 1997, and its activity is being defined as a subunit of cysteine synthase A and O-acetylserine sulfhydrolase A, PLP-dependent enzyme. Accordingly, in one embodiment, the process of the present invention comprises the use of a "subunit of cysteine synthase A and O-acetylserine sulfhydrolase A, PLP-dependent enzyme" from *E. coli* or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a protein of the superfamily "threonine dehydratase", preferably having an activity in amino acid biosynthesis, biosynthesis of the cysteine-aromatic group, degradation of amino acids of the cysteine-aromatic group, nitrogen and sulfur utilization biosynthesis of the aspartate family, degradation of amino acids of the aspartate group, biosynthesis of sulfuric acid and L-cysteine derivatives, biosynthesis of secondary products derived from primary amino acids, biosynthesis of secondary products derived from glycine, L-serine and L-alanine, pyridoxal phosphate binding, more preferred having an "subunit of cysteine synthase A and O-acetylserine sulfhydrolase A, PLP-dependent enzyme"-activity is increased or generated, e.g. from *E. coli* or a homolog thereof. Accordingly, in one embodiment, in the process of the present invention the activity of a "subunit of cysteine synthase A and O-acetylserine sulfhydrolase A, PLP-dependent enzyme" or its homolog is increased for the production of the fine chemical, meaning of methionine, in particular for increasing the amount of methionine in free or bound form in an organism or a part thereof, as mentioned.

The sequence of b2762 from *Escherichia coli* K12 has been published in Blattner, Science 277(5331), 1453-1474, 1997, and its activity is being defined as a 3'-phosphoadenosine 5'-phosphosulfate (PAPS) reductase. Accordingly, in one embodiment, the process of the present invention comprises the use of a "3'-phosphoadenosine 5'-phosphosulfate (PAPS) reductase" from *E. coli* or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a protein of the superfamily "3'-phosphoadenosine 5'-phosphosulfate reductase", preferably having an activity in biosynthesis of cysteine, nitrogen and sulfur utilization, amino acid biosynthesis more preferred having an "3'-phosphoadenosine 5'-phosphosulfate (PAPS) reductase"-activity is increased or generated, e.g. from *E. coli* or a homolog thereof. Accordingly, in one embodiment, in the process of the present invention the activity of a "3'-phosphoadenosine 5'-phosphosulfate (PAPS) reductase" or its homolog is increased for the production of the fine chemical, meaning of methionine, in particular for increasing the amount of methionine in free or bound form in an organism or a part thereof, as mentioned. The sequence of b4232 from *Escherichia coli* K12 has been published in Blattner, Science 277(5331), 1453-1474, 1997, and its activity is being defined as a fructose-1,6-bisphosphatase. Accordingly, in one embodiment, the process of the present invention comprises the use of a "fructose-1,6-bisphosphatase" from *E. coli* or its homolog, e.g. as shown herein, for the production of the fine chemical, meaning of methionine, in particular for increasing the amount of methionine in free or bound form in an organism or a part thereof, as mentioned. In one embodiment, in the process of the present invention the activity of a protein of the superfamily "fructose-bisphosphatase", preferably having an activity in C-compound and carbohydrate metabolism, C-compound and carbohydrate utilization, energy, glycolysis and gluconeogenesis, plastid, photosynthesis, more preferred having an "fructose-1,6-bisphosphatase"-activity, is increased or generated, e.g. from *E. coli* or a homolog thereof. Accordingly, in one embodiment, in the process of the present invention the activity of a "fructose-1,6-bisphosphatase" or its homolog is increased for the production of the fine chemical, meaning of methionine, in particular for increasing the amount of methionine in free or bound form in an organism or a part thereof, as mentioned.

Homologues (=homologs) of the present gene products can be derived from any organisms as long as the homologue confers the herein mentioned activity, in particular, confers an increase in the fine chemical amount or content. Further, in the present invention, the term "homologue" relates to the sequence of an organism having the highest sequence homology to the herein mentioned or listed sequences of all expressed sequences of said organism.

However, the person skilled in the art knows, that, preferably, the homologue has said the-fine-chemical-increasing activity and, if known, the same biological function or activity in the organism as at least one of the protein(s) indicated in Table I, Column 3, lines 1 to 5 and/or lines 334 to 338, e.g. having the sequence of a polypeptide encoded by a nucleic acid molecule comprising the sequence indicated in indicated in Table I, Column 5 or 7, lines 1 to 5 and/or lines 334 to 338.

In one embodiment, the homolog of any one of the polypeptides indicated in Table II, lines 1 to 4 is a homolog having the same or a similar activity, in particular an increase of activity confers an increase in the content of the fine chemical in the organisms and being derived from an Eukaryot. In one embodiment, the homolog of a polypeptide indicated in Table II, column 3, line 5 and/or lines 334 to 338 is a homolog having the same or a similar activity, in particular an increase of activity confers an increase in the content of the fine chemical in the organisms or part thereof, and being derived from bacteria. In one embodiment, the homolog of a polypeptide indicated in Table II, column 3, lines 1 to 4 is a homolog having the same or a similar activity, in particular an increase of activity confers an increase in the content of the fine chemical in an organisms or part thereof, and being derived from Fungi. In one embodiment, the homolog of a polypeptide indicated in Table II, column 3, line 5 and/or lines 334 to 338 is a homolog having the same or a similar activity, in particular an increase of activity confers an increase in the content of the fine chemical in the organisms or part thereof and being derived from Proteobacteria. In one embodiment, the homolog of a polypeptide indicated in Table II, column 3, lines 1 to 4 is a homolog having the same or a similar activity, in particular an increase of activity confers an increase in the content of the fine chemical in the organisms or a part thereof and being derived from Ascomycota. In one embodiment, the homolog of a polypeptide indicated in Table II, column 3, line 5 and/or lines 334 to 338 is a homolog having the same or a similar activity, in particular an increase of activity confers an increase in the content of the fine chemical in the organisms or part thereof, and being derived from Gammaproteobacteria. In one embodiment, the homolog of a polypeptide indicated in Table II, column 3, lines 1 to 4 is a homolog having the same or a similar activity, in particular an increase of activity confers an increase in the content of the fine chemical in the organisms or part thereof, and being derived from Saccharomycotina. In one embodiment, the homolog of a polypeptide indicated in Table II, column 3, line 5 and/or lines 334 to 338 is a homolog having the same or a similar activity, in particular an increase of activity confers an increase in the content of the fine chemical in the organisms or part thereof, and being derived from Enterobacteriales. In one embodiment, the homolog of a polypeptide indicated in Table II, column 3, lines 1 to 4 is a homolog having the same or a similar activity, in particular an increase of activity confers an increase in the content of the fine chemical in the organisms or a part thereof, and being derived from Saccharomycetes. In one embodiment, the homolog of the a polypeptide indicated in Table II, column 3, line 5 and/or lines 334 to 338 is a homolog having the same or a similar activity, in particular an increase of activity confers an increase in the content of the fine chemical in the organisms or part thereof, and being derived from Enterobacteriaceae. In one embodiment, the homolog of a polypeptide indicated in Table II, column 3, lines 1 to 4 is a homolog having the same or a similar activity, in particular an increase of activity confers an increase in the content of the fine chemical in the organisms, and being derived from Saccharomycetales. In one embodiment, the homolog of a polypeptide indicated in Table II, column 3, lines 5 and/or lines 334 to 338 is a homolog having the same or a similar activity, in particular an increase of activity confers an increase in the content of the fine chemical in the organisms or a part thereof, and being derived from *Escherichia*. In one embodiment, the homolog of a polypeptide indicated in Table II, column 3, lines 1 to 4 is a homolog having the same or a similar activity, in particular an increase of activity confers an increase in the content of the fine chemical in the organisms or a part thereof, and being derived from Saccharomycetaceae. In one embodiment, the homolog of a polypeptide indicated in Table II, column 3, line 1 to 4 is a homolog having the same or a similar activity, in particular an increase of activity confers an increase in the content of the fine chemical in the organisms or a part thereof, and being derived from Saccharomycetes.

Homologs of the polypeptides polypeptide indicated in Table II, column 3, lines 1 to 4 may be the polypeptides encoded by the nucleic acid molecules polypeptide indicated in Table I, column 7, lines 1 to 4 or may be the polypeptides indicated in Table II, column 7, lines 1 to 4.

Homologs of the polypeptides polypeptide indicated in Table II, column 3, line 5 and/or lines 334 to 338 may be the polypeptides encoded by the nucleic acid molecules polypeptide indicated in Table I, column 7, line 5 and/or lines 334 to 338 or may be the polypeptides indicated in Table II, column 7, lines 5 and/or lines 334 to 338.

Further homologs of are described herein below.

In accordance with the invention, a protein or polypeptide has the "activity of an protein of the invention", or of a protein as used in the invention, e.g. a protein having the activity of a protein indicated in Table II, column 3, lines 1 to 5 and/or lines 334 to 338 if its de novo activity, or its increased expression directly or indirectly leads to an increased methionine, preferably L-methionine level in the organism or a part thereof, preferably in a cell of said organism. In a preferred embodiment, the protein or polypeptide has the above-mentioned additional activities of a protein indicated in Table II, column 3, lines 1 to 5 and/or lines 334 to 338. During the specification the activity or preferably the biological activity of such a protein or polypeptide or an nucleic acid molecule or sequence encoding such protein or polypeptide is identical or similar if it still has the biological or enzymatic activity of any one of the proteins indicated in Table II, column 3, lines 1 to 5 and/or lines 334 to 338, i.e. if it has at least 10% of the original enzymatic activity, preferably 20%, particularly preferably 30%, most particularly preferably 40% in comparison to an any one of the proteins indicated in Table II, column 3, lines 1 to 4 of *Saccharomyces cerevisiae* and/or any one of the proteins indicated in Table II, column 3, line 5 and/or lines 334 to 338 of *E. coli* K12.

In one embodiment, the polypeptide of the invention or the polypeptide used in the method of the invention confers said activity, e.g. the increase of the fine chemical in an organism or a part thereof, if it is derived from an organism, which is evolutionary distant to the organism in which it is expressed. For example origin and expressing organism are derived from different families, orders, classes or phylums.

In one embodiment, the polypeptide of the invention or the polypeptide used in the method of the invention confers said activity, e.g. the increase of the fine chemical in an organism or a part thereof, if it is derived from an organism, which is evolutionary close to the organism indicated in Table I, column 4 and is expressed in an organism, which is evolutionary distant to the origin organism. For example origin and expressing organism are derived from different families, orders, classes or phylums whereas origin and the organism indicated in Table I, column 4 are derived from the same families, orders, classes or phylums.

The terms "increased", "rose", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change or the modulation of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild type cell. However, the terms increase or decrease as used herein also include the change or modulation of a property in the whole organism as mentioned.

Accordingly, the term "increase" or "decrease" means that the specific activity of an enzyme, preferably the amount of a compound or metabolite, e.g. of a polypeptide, a nucleic acid molecule or of the respective fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control, or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control, or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention or the polypeptide used in the method of the invention, e.g. as result of an increase in the level of the nucleic acid molecule of the present invention or an increase of the specific activity of the polypeptide of the invention or the polypeptide used in the method of the invention. E.g., it differs by or in the expression level or activity of an protein having the activity of a protein as indicated in Table II, column 3, lines 1 to 5 and/or lines 334 to 338 or being encoded by a nucleic acid molecule indicated in Table I, column 5, lines 1 to 5 and/or lines 334 to 338 or its homologs, e.g. as indicated in Table I, column 7, lines 1 to 5 and/or lines 334 to 338, its biochemical or genetical causes and therefore shows the increased amount of the fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of a protein, e.g. the polypeptide of the invention or the polypeptide used in the method of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by amplifying the number of gene(s), by modifying the regulation of the gene, or by increasing the stability of the corresponding mRNA or of the corresponding gene product encoded by the nucleic acid molecule of the invention or the nucleic acid molecule used in the method of the invention, or by introducing homologous genes from other organisms which are differently regulated, e.g. not feedback sensitive.

This also applies analogously to the combined increased expression of the nucleic acid molecule of the present invention or its gene product with that of further enzymes or regulators of the biosynthesis pathways of the respective fine chemical, e.g. which are useful for the synthesis of the respective fine chemicals.

The increase, decrease or modulation according to this invention can be constitutive, e.g. due to a stable permanent transgenic expression or to a stable mutation in the corresponding endogenous gene encoding the nucleic acid molecule of the invention or the nucleic acid molecule used in the method of the invention or to a modulation of the expression or of the behaviour of a gene conferring the expression of the polypeptide of the invention or the polypeptide used in the method of the invention, or transient, e.g. due to an transient transformation or temporary addition of a modulator such as a agonist or antagonist or inducible, e.g. after transformation with a inducible construct carrying the nucleic acid molecule of the invention or the nucleic acid molecule used in the method of the invention under control of a inducible promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the respective fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In one embodiment, in case the activity of the *Saccharomyces cerevisiae* protein YLR375W or its homologs, e.g. as indicated in Table II, columns 5 or 7, line 1, is increased; preferably, an increase of the fine chemical between 110% and 300% or more is conferred.

In one embodiment, in case the activity of the *Saccharomyces cerevisiae* protein YBL015w or an acetyl-CoA hydrolase, or its homologs, e.g. as indicated in Table II, columns 5 or 7, line 2, is increased; preferably, the increase of the fine chemical between 110% and 300% or more is conferred.

In one embodiment, in case the activity of the *Saccharomyces cerevisiae* protein YER173w or its homologs, e.g. as indicated in Table II, columns 5 or 7, line 3, e.g. a checkpoint protein, involved in the activation of the DNA damage and meiotic pychtene checkpoints; subunit of a clamp loader that loads Rad17p-Mec3p-Ddc1p onto DNA or Rad24p or its homologs, e.g. the human or *S. pombe* Rad17 is increased; preferably, the increase of the fine chemical between 110% and 200% or more is conferred.

In one embodiment, in case the activity of the *Saccharomyces cerevisiae* protein YOR084w or an putative Lipase of the peroxisomal matrix or its homologs, e.g. as indicated in Table II, columns 5 or 7, line 4, is increased; preferably, the increase of the fine chemical between 110% and 350% or more is conferred.

In one embodiment, in case the activity of the *Escherichia coli* K12 protein b1829 or its homologs, e.g. as indicated in Table II, columns 5 or 7, line 5, is increased, e.g. the activity of a protease is increased, preferably, the activity of a heat shock protein is increased, more preferred the activity of a htpX protein or its homolog is increased; preferably, the increase of the fine chemical between 110% and 400% or more is conferred.

In one embodiment, in case the activity of the *Escherichia coli* K12 protein b4232 or its homologs, e.g. as indicated in Table II, columns 5 or 7, line 338, is increased, e.g. the activity of a fructose-bisphosphatase-superfamily-protein is increased, preferably, the activity a protein involved in C-compound and carbohydrate metabolism, C-compound and carbohydrate utilization, ENERGY, glycolysis and gluconeogenesis, plastid, and/or photosynthesis is increased, more preferred the activity of a fructose-1,6-bisphosphatase or its homolog is increased. Preferably, the increase of the fine chemical around 20% or more is conferred.

In one embodiment, in case the activity of the *Escherichia coli* K12 protein b0464 or its homologs, e.g. as indicated in Table II, columns 5 or 7, line 334, is increased, e.g. the activity of a probable transcription repressor mtrr superfamily-protein is increased, preferably, the activity a protein involved in transcriptional control, and/or DNA binding is increased, more preferred the activity of a transcriptional repressor for multidrug efflux pump (TetR/AcrR family) or its homolog is increased preferably, an increase of the respective fine chemical around between 35% and 366% or more is conferred. In one embodiment, in case the activity of the *Escherichia coli* K12 protein b1343 or its homologs, e.g. as indicated in Table II, columns 5 or 7, line 335, is increased, e.g. the activity of a protein involved in rRNA processing and/or translation is increased, preferred the activity of a ATP-dependent RNA helicase, stimulated by 23S rRNA or its homolog is increased. Preferably, an increase of the respective fine chemical around between 38% and 51% or more is conferred.

In one embodiment, in case the activity of the *Escherichia coli* K12 protein b2414 or its homologs, e.g. as indicated in Table II, columns 5 or 7, line 336, is increased, e.g. the activity of a protein of the threonine dehydratase-superfamily is increased preferably the activity of a protein involved in amino acid biosynthesis, biosynthesis of the cysteine-aromatic group, degradation of amino acids of the cysteine-aromatic group, nitrogen and sulfur utilizationbiosynthesis of the aspartate family, degradation of amino acids of the aspartate group, biosynthesis of sulfuric acid and L-cysteine derivatives, biosynthesis of secondary products derived from primary amino acids, biosynthesis of secondary products derived from glycine, L-serine and L-alanine, pyridoxal phosphate binding is increased, preferred the activity of a subunit of cysteine synthase A and O-acetylserine sulfhydrolase A, PLP-dependent enzyme or its homolog is increased. Preferably, an increase of the respective fine chemical around between 37% and 75% or more is conferred.

In one embodiment, in case the activity of the *Escherichia coli* K12 protein b2762 or its homologs, e.g. as indicated in Table II, columns 5 or 7, line 337, is increased, e.g. the activity of a 3'-phosphoadenosine 5'-phosphosulfate reductase—superfamily-protein is increased, preferably, the activity a protein involved in C-compound and carbohydrate metabolism, C-compound and carbohydrate utilization, ENERGY, glycolysis and gluconeogenesis, plastid, and/or photosynthesis is increased, more preferred the activity of a fructose-1,6-bisphosphatase or its homolog is increased. Preferably, the increase of the fine chemical around 20% or more is conferred.

In one embodiment, in case the activity of the *Saccharomyces cerevisiae* protein YLR375W or its homologs is increased, preferably, an increase of the fine chemical and of shikimic acid is conferred.

In one embodiment, in case the activity of the *Saccharomyces cerevisiae* protein YBL015w or its homologs, e.g. an Ach1p, is increased, preferably, an increase of the fine chemical and of a further amino acid, e.g. alanine is conferred.

In one embodiment, in case the activity of the *Saccharomyces cerevisiae* protein YER173w or its homologs, e.g. a checkpoint protein, involved in the activation of the DNA damage and meiotic pychtene checkpoints; subunit of a clamp loader that loads Rad17p-Mec3p-Ddc1p onto DNA or Rad24p or its homologs, e.g. the human or *S. pombe* Rad17 is increased, preferably, an increase of the fine chemical and of a further amino acid, e.g. leucine, is conferred.

In one embodiment, in case the activity of the *Saccharomyces cerevisiae* protein YOR084w or a putative lipase of the peroxisomal matrix or its homologs is increased, preferably, an increase of the fine chemical and of beta-sitosterol is conferred.

In one embodiment, in case the activity of the *Escherichia coli* K12 protein b1829 or its homologs is increased, e.g. the activity of a protease is increased, preferably, the activity of a heat shock protein is increased, more preferred the activity of a htpX protein or its homolog is increased, preferably, an increase of the fine chemical and of a further amino acid, e.g. phenylalanine, is conferred.

In one embodiment, in case the activity of the *Escherichia coli* K12 protein b0464 or its homologs is increased, e.g. the activity of a transcriptional repressor for multidrug efflux pump (TetR/AcrR family) or its homolog is increased, preferably in an increase of the fine chemical and of a further amino acid is conferred.

In one embodiment, in case the activity of the *Escherichia coli* K12 protein b1343 or its homologs is increased, e.g. the activity of a ATP-dependent RNA helicase, stimulated by 23S rRNA is increased or its homolog is increased, preferably, an increase of the fine chemical and of a further amino acid is conferred.

In one embodiment, in case the activity of the *Escherichia coli* K12 protein b2414 or its homologs is increased, e.g. the activity of a subunit of cysteine synthase A and O-acetylserine sulfhydrolase A, PLP-dependent enzyme is increased.

In one embodiment, in case the activity of the *Escherichia coli* K12 protein b2762 or its homologs is increased, e.g. the activity of a 3'-phosphoadenosine 5'-phosphosulfate (PAPS) reductase or its homolog is increased, preferably, an increase of the fine chemical and of a further amino acid is conferred.

In one embodiment, in case the activity of the *Escherichia coli* K12 protein b4232 or its homologs is increased, e.g. the activity of a ructose-1,6-bisphosphatase or its homolog is increased, preferably, an increase of the fine chemical and of a further amino acid is conferred.

In this context, the respective fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The respective fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the respective fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of the respective fine chemical preferably has the structure of the polypeptide described herein, in particular of a polypeptides comprising a consensus sequence as indicated in Table IV, columns 7, line 1 to 5 or lines 334 to 338 or of a polypeptide as indicated in Table II, columns 5 or 7, line 1 to 5 or lines 334 to 338 or the functional homologues thereof as described herein, or of a polypeptide which is encoded by the nucleic acid molecule characterized herein or the nucleic acid molecule according to the invention, for example by a nucleic acid molecule as indicated in Table I, columns 5 or 7, line 1 to 5 or lines 334 to 338 or its herein described functional homologues and has the herein mentioned activity.

For the purposes of the present invention, the terms "L-methionine", "methionine", "homocysteine", "S-adenosylmethionine" and "threonine" also encompass the corresponding salts, such as, for example, methionine hydrochloride or methionine sulfate. Preferably the terms methionine or threonine are intended to encompass the terms L-methionine or L-threonine.

Owing to the biological activity of the proteins which are used in the process according to the invention and which are encoded by nucleic acid molecules according to the invention, it is possible to produce compositions comprising the respective fine chemical, i.e. an increased amount of the free chemical free or bound, e.g. fine chemical compositions. Depending on the choice of the organism used for the process according to the present invention, for example a microorganism or a plant, compositions or mixtures of various fine chemicals, e.g. comprising further distinct amino acids, fatty acids, vitamins, hormones, sugars, lipids, etc. can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps:
 a) stabilizing a protein conferring the increased expression of a protein encoded by the nucleic acid molecule of the invention or of the polypeptid of the invention or the nucleic acid molecule or the polypeptide used in the method of the invention, e.g. of a polypeptide having an activity of a protein as indicated in Table II, column 3, lines 1 to 5 or lines 334 to 338 or its homologs activity, e.g. as indicated in Table II, columns 5 or 7, lines 1 to 5 or lines 334 to 338, having herein-mentioned the fine chemical-increasing activity;
 b) stabilizing a mRNA conferring the increased expression of a protein encoded by the nucleic acid molecule of the invention or the nucleic acid molecule used in the method of the invention, e.g. of a polypeptide having an activity of a protein as indicated in Table II, column 3, lines 1 to 5 or lines 334 to 338 or its homologs activity, e.g. as indicated in Table II, columns 5 or 7, lines 1 to 5 or lines 334 to 338, or of a mRNA encoding the polypeptide of the present invention having herein-mentioned methionine increasing activity;
 c) increasing the specific activity of a protein conferring the increased expression of a protein encoded by the nucleic acid molecule of the invention or of the polypeptide of the present invention or the nucleic acid molecule or polypeptide used in the method of the invention, having herein-mentioned methionine increasing activity, e.g. of a polypeptide having an activity of a protein as indicated in Table II, column 3, line 1 to 5 or lines 334 to 338, or its homologs activity, e.g. as indicated in Table II, columns 5 or 7, line 1 to 5 or lines 334 to 338, or decreasing the inhibitory regulation of the polypeptide of the invention or the polypeptide used in the method of the invention;
 d) generating or increasing the expression of an endogenous or artificial transcription factor mediating the expression of a protein conferring the increased expression of a protein encoded by the nucleic acid molecule of the invention or the nucleic acid molecule used in the method of the invention or of the polypeptide of the invention or the polypeptide used in the method of the invention having herein-mentioned methionine increasing activity, e.g. of a polypeptide having an activity of a protein as indicated in Table II, column 3, line 1 to 5 or lines 334 to 338, or its homologs activity, e.g. as indicated in Table II, columns 5 or 7, line 1 to 5 or lines 334 to 338;
 e) stimulating activity of a protein conferring the increased expression of a protein encoded by the nucleic acid molecule of the present invention or a polypeptide of the present invention having herein-mentioned methionine increasing activity, e.g. of a polypeptide having an activity of a protein as indicated in Table II, column 3, lines 1 to 5 or lines 334 to 338, or its homologs activity, e.g. as indicated in Table II, columns 5 or 7, lines 1 to 5 or lines 334 to 338, by adding one or more exogenous inducing factors to the organism or parts thereof;
 f) expressing a transgenic gene encoding a protein conferring the increased expression of a polypeptide encoded by the nucleic acid molecule of the present invention or a polypeptide of the present invention, having herein-mentioned methionine increasing activity, e.g. of a polypeptide having an activity of a protein as indicated in Table II, column 3, lines 1 to 5 or lines 334 to 338, or its homologs activity, e.g. as indicated in Table II, columns 5 or 7, lines 1 to 5 or lines 334 to 338;
 g) increasing the copy number of a gene conferring the increased expression of a nucleic acid molecule encoding a polypeptide encoded by the nucleic acid molecule of the invention or the nucleic acid molecule used in the method of the invention or the polypeptide of the invention or the polypeptide used in the method of the invention having herein-mentioned methionine increasing activity, e.g. of a polypeptide having an activity of a protein as indicated in Table II, column 3, lines 1 to 5 or lines 334 to 338, or its homologs activity, e.g. as indicated in Table II, columns 5 or 7, lines 1 to 5 or lines 334 to 338;
 h) Increasing the expression of the endogenous gene encoding the polypeptide of the invention or the polypeptide used in the method of the invention, e.g. a polypeptide having an activity of a protein as indicated in Table II, column 3, line 1 to 5 or lines 334 to 338, or its homologs activity, e.g. as indicated in Table II, columns 5 or 7, line 1 to 5 or lines 334 to 338, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced;

i) Modulating growth conditions of an organism in such a manner, that the expression or activity of the gene encoding the protein of the invention or the protein itself is enhanced for example microorganisms or plants can be grown under a higher temperature regime leading to an enhanced expression of heat shock proteins, e.g. the heat shock protein of the invention, which can lead an enhanced the fine chemical production; and/or j) selecting of organisms with especially high activity of the proteins of the invention from natural or from mutagenized resources and breeding them into the target organisms, e.g. the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring the increase of methionine after increasing the expression or activity of the encoded polypeptide or having the activity of a polypeptide having an activity of a protein as indicated in Table II, columns 5 or 7, lines 1 to 5 and/or lines 334 to 338 or its homologs activity, e.g. as indicated in Table II, columns 5 or 7, lines 1 to 5 and/or lines 334 to 338.

In general, the amount of mRNA or polypeptide in a cell or a compartment of a organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention or the polypeptide used in the method of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell, or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, a organ, an organelle etc., is achieved by increasing the endogenous level of the polypeptide of the invention or the polypeptide used in the method of the invention. Accordingly, in an embodiment of the present invention, the present invention relates to a process wherein the gene copy number of a gene encoding the polynucleotide or nucleic acid molecule of the invention or the nucleic acid molecule used in the method of the invention as herein described is increased. Further, the endogenous level of the polypeptide of the invention or the polypeptide used in the method of the invention as described can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others cited therein. Reverse genetic strategies to identify insertions (which eventually carrying the activation elements) near in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as tilling (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, of the polypeptide of the invention or the polypeptide used in the method of the invention, e.g. conferring the increase of the respective fine chemical after increase of expression or activity can also be increased by introducing a synthetic transcription factor, which binds close to the coding region of an endogenous polypeptide of the invention or the polypeptide used in the method of the invention- or used in the process of the invention or its endogenous homolog-encoding gene and the synthetic transcription factor activates its transcription. A chimeric zinc finger protein can be construed, which comprises a specific DNA-binding domain and an activation domain as e.g. the VP16 domain of Herpes Simplex virus. The specific binding domain can bind to the regulatory region of the endogenous protein coding region. The expression of the chimeric transcription factor in a organism, in particular in a plant, leads to a specific expression of an endogenous polypeptide of the invention or used in the process of the invention, in particular a plant homolog thereof, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It is therefore advantageously to express in an organism a nucleic acid molecule of the invention or the nucleic acid molecule used in the method of the invention or a polypeptide of the invention or the polypeptide used in the method of the invention derived from a evolutionary distantly related organism, as e.g. using a prokaryotic gene in an eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired respective fine chemical(s).

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below, into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) respective fine chemicals, in particular amino acids, likewise the fine chemical.

Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids or its precursors, required for the cell's biosynthesis of amino acids may be increased so that the concentration of necessary or relevant precursors, cofactors or intermediates within the cell(s) or within the corresponding storage compartments is increased. Owing to the increased or novel generated activity of the polypeptide of the invention or the polypeptide used in the method of the invention or owing to the increased number of nucleic acid sequences of the invention and/or to the modulation of further genes which are involved in the biosynthesis of the amino acids, e.g. by increasing the activity of enzymes synthesizing precursors or by destroying the activity of one or more genes which are involved in the breakdown of the amino acids, it is possible to increase the yield, production and/or production efficiency of amino acids in the host organism, such as the plants or the microorganisms.

By influencing the metabolism thus, it is possible to produce, in the process according to the invention, further advantageous sulfur-containing compounds, which contain at least one sulfur atom bound covalently. Examples of such compounds are, in addition to methionine, homocysteine, S-adenosylmethionine, cysteine, advantageously methionine and S-adenosylmethionine.

Accordingly, in one embodiment, the process according to the invention relates to a process which comprises:
a) providing a non-human organism, preferably a microorganism, a non-human animal, a plant or animal cell, a plant or animal tissue or a plant;
b) increasing an activity of a polypeptide of the invention or the polypeptide used in the method of the invention or a homolog thereof, e.g. as indicated in Table II, columns 5 or 7, line 1 to 5, or of a polypeptide being encoded by the nucleic acid molecule of the present invention and described below, i.e. conferring an increase of the respective fine chemical in the organism, preferably in a microorganism, a non-human animal, a plant or animal cell, a plant or animal tissue or a plant,
c) growing the organism, preferably a microorganism, a non-human animal, a plant or animal cell, a plant or animal tissue or a plant, under conditions which permit the production of the respective fine chemical in the organism, preferably the microorganism, the plant cell, the plant tissue or the plant; and
d) if desired, recovering, optionally isolating, the free and/or bound the respective fine chemical and, optionally further free and/or bound amino acids synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the fine chemical but as option it is also possible to produce, recover and, if desired isolate, other free or/and bound amino acids, in particular lysine. Galili et al., Transgenic Res., 200, 9, 2, 137-144 describes that the heterologous expression of a bacterial gene for the amino acid biosynthesis confers the increase of free as well as of protein-bound amino acids.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the respective fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the respective fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae Tuberculariaceae, Adelotheciaceae, Dinophyceae, Ditrichaceae or Prasinophyceae, or a prokaryotic organism, for example a bacterium or blue alga, in particular a bacterium from the families Actinomycetaceae, Bacillaceae, Brevibacteriaceae, Corynebacteriaceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The microorganisms or the recovered, and if desired isolated, respective fine chemical can then be processed further directly into foodstuffs or animal feeds or for other applications, for example according to the disclosures made in EP-B-0 533 039 or EP-A-0 615 693, which are expressly incorporated herein by reference. The fermentation broth or fermentation products can be purified in the customary manner by extraction and precipitation or via ion exchangers and other methods known to the person skilled in the art and described herein below. Products of these different work-up procedures are amino acids or amino acid compositions which still comprise fermentation broth and cell components in different amounts, advantageously in the range of from 0 to 99% by weight, preferably below 80% by weight, especially preferably between below 50% by weight.

Preferred microorganisms are selected from the group consisting of Chaetomiaceae such as the genera *Chaetomium* e.g. the species *Chaetomidium fimeti*; Choanephoraceae such as the genera *Blakeslea, Choanephora* e.g. the species *Blakeslea trispora, Choanephora cucurbitarum* or *Choanephora infundibulifera* var. *cucurbitarum*; Cryptococcaceae such as the genera *Candida, Crytococcus, Rhodotorula, Torulopsis* e.g. the species *Candida albicans, Candida albomarginata, Candida antarctica, Candida bacarum, Candida bogoriensis, Candida boidinii, Candida bovina, Candida brumptii, Candida cacaoi, Candida cariosilignicola, Candida catenulata, Candida chalmersii, Candida ciferrii, Candida cylindracea, Candida edax, Candida ernobii, Candida famata, Candida freyschussii, Candida friedrichii, Candida glabrata, Candida guiffiermondii, Candida haemulonii, Candida humicola, Candida inconspicua, Candida ingens, Candida intermedia, Candida kefyr, Candida krusei, Candida lactiscondensi, Candida lambica, Candida lipolytica, Candida lusitaniae, Candida macedoniensis, Candida magnoliae, Candida membranaefaciens, Candida mesenterica, Candida multigemmis, Candida mycoderma, Candida nemodendra, Candida nitratophila, Candida norvegensis, Candida norvegica, Candida parapsilosis, Candida pelliculosa, Candida peltata, Candida pini, Candida pseudotropicalis, Candida pulcherrima, Candida punicea, Candida pustula, Candida ravautii, Candida reukaufii, Candida rugosa, Candida sake, Candida silvicola, Candida solani, Candida* sp., *Candida spandovensis, Candida succiphila, Candida tropicalis, Candida utilis, Candida valida, Candida versatilis, Candida vini, Candida zeylanoides, Cryptococcus albidus, Cryptococcus curvatus, Cryptococcus flavus, Cryptococcus humicola, Cryptococcus hungaricus, Cryptococcus kuetzingii, Cryptococcus laurentii, Cryptococcus macerans, Cryptococcus neoformans, Cryptococcus terreus, Cryptococcus uniguttulatus, Rhodotorula acheniorum, Rhodotorula bacarum, Rhodotorula bogoriensis, Rhodotorula flava, Rhodotorula glutinis, Rhodotorula macerans, Rhodotorula minuta, Rhodotorula mucilaginosa, Rhodotorula pilimanae, Rhodotorula pustula, Rhodotorula rubra, Rhodotorula tokyoensis, Torulopsis colliculosa, Torulopsis dattila* or *Torulopsis neoformans*; Cunninghamellaceae such as the genera *Cunninghamella* e.g. the species *Cunninghamella blakesleeana, Cunninghamella echinulata, Cunninghamella echinulata* var. *elegans, Cunninghamella elegans* or *Cunninghamella homothallica*; Demetiaceae such as the genera *Alternaria, Bipolaris, Cercospora, Chalara, Cladosporium, Curvularia, Exophilia, Helicosporium, Helminthosporium, Orbimyces, Philalophora, Pithomyces, Spilocaea, Thielaviopsis, Wangiella* e.g. the species *Curvularia affinis, Curvularia clavata, Curvularia fallax, Curvularia inaequalis, Curvularia indica, Curvularia lunata, Curvularia pallescens, Curvularia verruculosa* or *Helminothosporium* sp.; Moniliaceae such as the genera *Arthrobotrys, Aspergillus, Epidermophyton, Geotrichum, Gliocladium, Histoplasma, Microsporum, Monilia, Oedocephalum, Oidium, Penicillium, Trichoderma, Trichophyton, Thrichoteclum, Verticillium* e.g. the species *Aspergillus aculeatus, Aspergillus albus, Aspergillus alliaceus, Aspergillus asperescens, Aspergillus awamori, Aspergillus candidus, Aspergillus carbonarius, Aspergillus carneus, Aspergillus chevalieri, Aspergillus chevalieri* var. *intermedius, Aspergillus clavatus, Aspergillus ficuum, Aspergillus flavipes, Aspergillus flavus, Aspergillus foetidus, Aspergillus fumigatus, Aspergillus giganteus, Aspergillus humicola, Aspergillus intermedius, Aspergillus japonicus, Aspergillus nidulans, Aspergillus niger, Aspergillus niveus, Aspergillus ochraceus, Aspergillus oryzae, Aspergillus ostianus, Aspergillus parasiticus, Aspergillus parasiticus* var. *globosus, Aspergillus penicillioides, Aspergillus phoenicis, Aspergillus rugulosus, Aspergillus sclerotiorum, Aspergillus sojae* var. *gymnosardae, Aspergillus sydowi, Aspergillus tamarii, Aspergillus terreus, Aspergillus terricola, Aspergillus toxicarius, Aspergillus unguis, Aspergillus ustus, Aspergillus versicolor, Aspergillus vitricolae, Aspergillus wentii,* •*Penicillium adametzi,* •*Penicillium albicans, Penicillium arabicum, Penicillium arenicola, Penicillium argillaceum, Penicillium arvense, Penicillium asperosporum,* •*Penicillium aurantiogriseum,* •*Penicillium avellaneum,* •*Penicillium baarnense,* •*Penicillium bacillisporum,* •*Penicillium brasilianum,* •*Penicillium brevicompactum,* •*Penicillium camemberti,* •*Penicillium canadense,* •*Penicillium canescens,* •*Penicillium caperatum,* •*Penicillium capsulatum,* •*Penicillium caseicolum,* •*Penicillium chrysogenum,* •*Penicillium citreonigrum,* •*Penicillium citrinum,* •*Penicillium claviforme,* •*Penicillium commune,* •*Penicillium corylophilum,* •*Penicillium corymbiferum,* •*Penicillium crustosum,* •*Penicillium cyclopium,* •*Penicillium daleae,* •*Penicillium decumbens,* •*Penicillium dierckxii,* •*Penicillium digitatum,* •*Penicillium digitatum* var. *latum,* •*Penicillium divaricatum,* •*Penicillium diversum,* •*Penicillium duclauxii,* •*Penicillium echinosporum,* •*Penicillium expansum,* •*Penicillium fellutanum,* •*Penicillium frequentans,* •*Penicillium funiculosum,* •*Penicillium glabrum,* •*Penicillium gladioli,* •*Penicillium griseofulvum,* •*Penicillium hirsutum,* •*Penicillium hispanicum,* •*Penicillium islandicum,* •*Penicillium italicum,* •*Penicillium italicum* var. *avellaneum,* •*Penicillium janczewskii,* •*Penicillium janthinellum,* •*Penicillium japonicum,* •*Penicillium lavendulum,* •*Penicillium lilacinum,* •*Penicillium lividum,* •*Penicillium martensii,* •*Penicillium megasporum,* •*Penicillium miczynskii,* •*Penicillium nalgiovense,* •*Penicillium nigricans,* •*Penicillium notatum,* •*Penicillium ochrochloron,* •*Penicillium odoratum,* •*Penicillium oxalicum,* •*Penicillium paraherquei,* •*Penicillium patulum,* •*Penicillium pinophilum,* •*Penicillium piscarium,* •*Penicillium pseudostromaticum,* •*Penicillium puberulum,* •*Penicillium purpurogenum,* •*Penicillium raciborskii,* •*Penicillium roqueforti,* •*Penicillium rotundum,* •*Penicillium rubrum,* •*Penicillium sacculum,* •*Penicillium simplicissimum, Penicillium* sp., *Penicillium spinulosum, Penicillium steckii, Penicillium stoloniferum, Penicillium striatisporum, Penicillium striatum, Penicillium tardum, Penicillium thomii, Penicillium turbatum, Penicillium variabile, Penicillium vermiculatum, Penicillium vermoesenii, Penicillium verrucosum, Penicillium verrucosum* var. *corymbiferum, Penicillium verrucosum* var. *cyclopium, Penicillium verruculosum, Penicillium vinaceum, Penicillium violaceum, Penicillium viridicatum, Penicillium vulpinum, Trichoderma hamatum, Trichoderma harzianum, Trichoderma koningii, Trichoderma longibrachiatum, Trichoderma polysporum, Trichoderma reesei, Trichoderma virens* or *Trichoderma viride*; Mortierellaceae such as the genera *Mortierella* e.g. the species *Mortierella isabellina, Mortierella polycephala, Mortierella ramanniana, Mortierella vinacea* or *Mortierella zonata*; Mucoraceae such as the genera *Actinomucor, Mucor, Phycomyces, Rhizopus, Zygorhynchus* e.g. the species *Mucor amphibiorum, Mucor circinelloides* f. *circinelloides, Mucor*

*circinelloides* var. *griseocyanus, Mucor flavus, Mucor fuscus, Mucor griseocyanus, Mucor heterosporus, Mucor hiemalis, Mucor hiemalis* f. *hiemalis, Mucor inaequisporus, Mucor indicus, Mucorjavanicus, Mucor mucedo, Mucor mucilagineus, Mucor piriformis, Mucor plasmaticus, Mucor plumbeus, Mucor racemosus, Mucor racemosus* f. *racemosus, Mucor racemosus* f. *sphaerosporus, Mucor rouxianus, Mucor rouxii, Mucor sinensis, Mucor* sp., *Mucor spinosus, Mucor tuberculisporus, Mucor variisporus, Mucor variosporus, Mucor wosnessenskii, Phycomyces blakesleeanus, Rhizopus achiamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus* var. *chinensis, Rhizopus microsporus* var. *oligosporus, Rhizopus microsporus* var. *rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici* or *Rhizopus usamii*; Pythiaceae such as the genera *Phytium, Phytophthora* e.g. the species *Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae* var. *parasitica, Phytophthora palmivora, Phytophthora parasitica* or *Phytophthora syringae*; Sacharomycetaceae such as the genera *Hansenula, Pichia, Saccharomyces, Saccharomycodes, Yarrowia* e.g. the species *Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii, Pichia cellobiosa, Pichia ciferrii, Pichia farinosa, Pichia fermentans, Pichia finlandica, Pichia glucozyma, Pichia guiffiermondii, Pichia haplophila, Pichia henricii, Pichia holstii, Pichia jadinii, Pichia lindnerii, Pichia membranaefaciens, Pichia methanolica, Pichia minuta* var. *minuta, Pichia minuta* var. *nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces baffii, Saccharomyces bayanus, Saccharomyces bisporus, Saccharomyces capensis, Saccharomyces carlsbergensis, Saccharomyces cerevisiae, Saccharomyces cerevisiae* var. *ellipsoideus, Saccharomyces chevalieri, Saccharomyces delbrueckii, Saccharomyces diastaticus, Saccharomyces drosophilarum, Saccharomyces elegans, Saccharomyces effipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii* or *Yarrowia lipolytica*; Saprolegniaceae such as the genera *Saprolegnia* e.g. the species *Saprolegnia ferax*; Schizosacharomycetaceae such as the genera *Schizosaccharomyces* e.g. the species *Schizosaccharomyces japonicus* var. *japonicus, Schizosaccharomyces japonicus* var. *versatilis, Schizosaccharomyces malidevorans, Schizosaccharomyces octosporus, Schizosaccharomyces pombe* var. *malidevorans* or *Schizosaccharomyces pombe* var. *pombe*; Sodariaceae such as the genera *Neurospora, Sordaria* e.g. the species *Neurospora africana, Neurospora crassa, Neurospora intermedia, Neurospora sitophila, Neurospora tetrasperma, Sordaria fimicola* or *Sordaria macrospora*; Tuberculariaceae such as the genera *Epicoccum, Fusarium, Myrothecium, Sphacelia, Starkeyomyces, Tubercularia* e.g. the species *Fusarium acuminatum, Fusarium anthophilum, Fusarium aquaeductuum, Fusarium aquaeductuum* var. *medium, Fusarium avenaceum, Fusarium buharicum, Fusarium camptoceras, Fusarium cerealis, Fusarium chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusarium equiseti* var. *bullatum, Fusarium eumartii, Fusarium flocciferum, Fusarium fujikuroi, Fusarium graminearum, Fusarium graminum, Fusarium heterosporum, Fusarium incarnatum, Fusarium inflexum, Fusarium javanicum, Fusarium lateritium, Fusarium lateritium* var. *majus, Fusarium longipes, Fusarium melanochlorum, Fusarium merismoides, Fusarium merismoides* var. *chlamydosporale, Fusarium moniliforme, Fusarium moniliforme* var. *anthophilum, Fusarium moniliforme* var. *subglutinans, Fusarium nivale, Fusarium nivale* var. *majus, Fusarium oxysporum, Fusarium oxysporum* f. sp. *aechmeae, Fusarium oxysporum* f. sp. *cepae, Fusarium oxysporum* f. sp. *conglutinans, Fusarium oxysporum* f. sp. *cucumerinum, Fusarium oxysporum* f. sp. *cyclaminis, Fusarium oxysporum* f. sp. *dianthi, Fusarium oxysporum* f. sp. *lycopersici, Fusarium oxysporum* f. sp. *melonis, Fusarium oxysporum* f. sp. *passiflorae, Fusarium oxysporum* f. sp. *pisi, Fusarium oxysporum* f. sp. *tracheiphilum, Fusarium oxysporum* f. sp. *tuberosi, Fusarium oxysporum* f. sp. *tulipae, Fusarium oxysporum* f. sp. *vasinfectum, Fusarium pallidoroseum, Fusarium poae, Fusarium proliferatum, Fusarium proliferatum* var. *minus, Fusarium redolens, Fusarium redolens* f. sp. *dianthi, Fusarium reticulatum, Fusarium roseum, Fusarium sacchari* var. *elongatum, Fusarium sambucinum, Fusarium sambucinum* var. *coeruleum, Fusarium semitectum, Fusarium semitectum* var. *majus, Fusarium solani, Fusarium solani* f. sp. *pisi, Fusarium sporotrichioides, Fusarium sporotrichioides* var. *minus, Fusarium sublunatum, Fusarium succisae, Fusarium sulphureum, Fusarium tabacinum, Fusarium tricinctum, Fusarium udum, Fusarium ventricosum, Fusarium verticillioides, Fusarium xylarioides* or *Fusarium zonatum*; Sporobolomycetaceae such as the genera *Bullera, Sporobolomyces, Itersonilia* e.g. the species *Sporobolomyces holsaticus, Sporobolomyces odorus, Sporobolomyces puniceus, Sporobolomyces salmonicolor, Sporobolomyces singularis* or *Sporobolomyces tsugae*; Adelotheciaceae such as the genera e.g. the species *Physcomitrella patens*; Dinophyceae such as the genera *Crypthecodinium, Phaeodactylum* e.g. the species *Crypthecodinium cohnii* or *Phaeodactylum tricornutum*; Ditrichaceae such as the genera *Ceratodon, Pleuridium, Astomiopsis, Ditrichum, Philibertiella, Ceratodon, Distichium, Skottsbergia* e.g. the species *Ceratodon antarcticus, Ceratodon purpureus, Ceratodon purpureus* ssp. *convolutes* or *Ceratodon purpureus* ssp.

*stenocarpus*; Prasinophyceae such as the genera *Nephroselmis, Prasinococcus, Scherffelia, Tetraselmis, Mantoniella, Ostreococcus* e.g. the species *Nephroselmis olivacea, Prasinococcus capsulatus, Scherffelia dubia, Tetraselmis chui, Tetraselmis suecica, Mantoniella squamata* or *Ostreococcus tauri*; Actinomycetaceae such as the genera *Actinomyces, Actinobaculum, Arcanobacterium, Mobiluncus* e.g. the species *Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii* subsp. *anitratus, Actinomyces neuii* subsp. *neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii* subsp. *curtisii, Mobiluncus curtisii* subsp. *holmesii* or *Mobiluncus mulieris*; Bacillaceae such as the genera *Amphibacillus, Anoxybacillus, Bacillus, Exiguobacterium, Gracilibacillus, Holobacillus, Saccharococcus, Salibacillus, Virgibacillus* e.g. the species *Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius, Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borstelensis, Bacillus brevis, Bacillus carboniphilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus* subsp. *fusiformis, Bacillus galactophilus, Bacillus globisporus, Bacillus globisporus* subsp. *marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquariensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis* subsp. *spizizenii, Bacillus subtilis* subsp. *subtilis, Bacillus thermantarcticus, Bacillus thermoaerophilus, Bacillus thermoamylovorans, Bacillus thermoantarcticus, Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetylicum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus truepefi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii* or *Virgibacillus salexigens*, Brevibacteriaceae such as the genera *Brevibacterium* e.g. the species *Brevibacterium acetyllcum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum* or *Brevibacterium vitaeruminis*; Corynebacteriaceae such as the genera *Corynebacterium* e.g. the species *Corynebacterium accolens, Corynebacterium afermentans* subsp. *afermentans, Corynebacterium afermentans* subsp. *lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium elides, Corynebacterium imitans, Corynebacterium insidiosum, Corynebacterium iranicum, Coryne-* bacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacterium michiganense subsp. tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis or Corynebacterium xerosis; Enterobacteriacae such as the genera Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingella, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia and Yokenella e.g. the species Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izardii, Buttiauxella noackiae, Buttiauxella warmbo/diae, Cedecea davisae, Cedecea lapagei, Cedecea neteri, Citrobacter ama/onaticus, Citrobacter diversus, Citrobacter freundii, Citrobacter genomospecies, Citrobacter gillenii, Citrobacter intermedium, Citrobacter koseri, Citrobacter murliniae, Citrobacter sp., Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora subsp. atroseptica, Erwinia carotovora subsp. betavasculorum, Erwinia carotovora subsp. odorifera, Erwinia carotovora subsp. wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxylata, Escherichia anindolica, Escherichia aurescens, Escherichia blattae, Escherichia coli, Escherichia coli var. communior, Escherichia coli-mutabile, Escherichia fergusonii, Escherichia hermannii, Escherichia sp., Escherichia vulneris, Ewingella americana, Hafnia alvei, Klebsiella aerogenes, Klebsiella edwardsii subsp. atlantae, Klebsiella ornithinolytica, Klebsiella oxytoca, Klebsiella planticola, Klebsiella pneumoniae, Klebsiella pneumoniae subsp. pneumoniae, Klebsiella sp., Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera sp., Leclercia adecarboxylata, Leminorella grimontii, Leminorella richardii, Moellerella wisconsensis, Morganella morganii, Morganella morganii subsp. morganii, Morganella morganii subsp. Obesumbaterium proteus, Pantoea agglomerans, Pantoea ananatis, Pantoea citrea, Pantoea dispersa, Pantoea punctata, Pantoea stewartii subsp. stewartii, Pantoea terrea, Pectobacterium atrosepticum, Pectobacterium carotovorum subsp. atrosepticum, Pectobacterium carotovorum subsp. carotovorum, Pectobacterium chrysanthemi, Pectobacterium cypripedii, Photorhabdus asymbiotica, Photorhabdus luminescens, Photorhabdus luminescens subsp. akhurstii, Photorhabdus luminescens subsp. laumondii, Photorhabdus luminescens subsp. luminescens, Photorhabdus sp., Photorhabdus temperata, Plesiomonas shigelloides, Pragia fontium, Proteus hauseri, Proteus ichthyosmius, Proteus inconstans, Proteus mirabilis, Proteus morganii, Proteus myxofaciens, Proteus penneri, Proteus rettgeri, Proteus shigelloides, Proteus vulgaris, Providencia alcalifaciens, Providencia friedericiana, Providencia heimbachae, Providencia rettgeri, Providencia rustigianii, Providencia stuartii, Rahnella aquatilis, Salmonella abony, Salmonella arizonae, Salmonella bongori, Salmonella choleraesuis subsp. arizonae, Salmonella choleraesuis subsp. bongori, Salmonella choleraesuis subsp. choleasuis, Salmonella choleraesuis subsp. diarizonae, Salmonella choleraesuis subsp. houtenae, Salmonella choleraesuis subsp. indica, Salmonella choleraesuis subsp. salamae, Salmonella daressalaam, Salmonella enterica subsp. houtenae, Salmonella enterica subsp. salamae, Salmonella enteritidis, Salmonella gallinarum, Salmonella heidelberg, Salmonella panama, Salmonella senftenberg, Salmonella typhimurium, Serratia entomophila, Serratia ficaria, Serratia fonticola, Serratia grimesii, Serratia liquefaciens, Serratia marcescens, Serratia marcescens subsp. marcescens, Serratia marinorubra, Serratia odorifera, Serratia plymouthensis, Serratia plymuthica, Serratia proteamaculans, Serratia proteamaculans subsp. quinovora, Serratia quinivorans, Serratia rubidaea, Shigella boydii, Shigella flexneri, Shigella paradysenteriae, Shigella sonnei, Tatumella ptyseos, Xenorhabdus beddingii, Xenorhabdus bovienii, Xenorhabdus luminescens, Xenorhabdus nematophila, Xenorhabdus nematophila subsp. beddingii, Xenorhabdus nematophila subsp. bovienii, Xenorhabdus nematophila subsp. poinarii or Xenorhabdus poinarii; Gordoniaceae such as the genera Gordonia, Skermania e.g. the species Gordonia aichiensis, Gordonia alkanivorans, Gordonia amarae, Gordonia amicalis, Gordonia bronchialis, Gordonia desulfuricans, Gordonia hirsuta, Gordonia hydrophobica, Gordonia namibiensis, Gordonia nitida, Gordonia paraffinivorans, Gordonia polyisoprenivorans, Gordonia rhizosphera, Gordonia rubripertincta, Gordonia sihwensis, Gordonia sinesedis, Gordonia sputi, Gordonia terrae or Gordonia westfalica; Micrococcaceae such as the genera Micrococcus, Arthrobacter, Kocuria, Nesterenkonia, Renibacterium, Rothia, Stomatococcus e.g. the species Micrococcus agilis, Micrococcus antarcticus, Micrococcus halobius, Micrococcus kristinae, Micrococcus luteus, Micrococcus lylae, Micrococcus nishinomiyaensis, Micrococcus roseus, Micrococcus sedentarius, Micrococcus varians, Arthrobacter agilis, Arthrobacter albus, Arthrobacter atrocyaneus, Arthrobacter aurescens, Arthrobacter chlorophenolicus, Arthrobacter citreus, Arthrobacter creatinolyticus, Arthrobacter crystallopoietes, Arthrobacter cumminsii, Arthrobacter duodecadis, Arthrobacter flavescens, Arthrobacter flavus, Arthrobacter gandavensis, Arthrobacter globiformis, Arthrobacter histidinolovorans, Arthrobacter ilicis, Arthrobacter koreensis, Arthrobacter luteolus, Arthrobacter methylotrophus, Arthrobacter mysorens, Arthrobacter nasiphocae, Arthrobacter nicotianae, Arthrobacter nicotinovorans, Arthrobacter oxydans, Arthrobacter pascens, Arthrobacter picolinophilus, Arthrobacter polychromogenes, Arthrobacter protophormiae, Arthrobacter psychrolactophilus, Arthrobacter radiotolerans, Arthrobacter ramosus, Arthrobacter rhombi, Arthrobacter roseus, Arthrobacter siderocapsulatus, Arthrobacter simplex, Arthrobacter sulfonivorans, Arthrobacter sulfureus, Arthrobacter terregens, Arthrobacter tumescens, Arthrobacter uratoxydans, Arthrobacter ureafaciens, Arthrobacter variabilis, Arthrobacter viscosus, Arthrobacter woluwensis, Kocuria erythromyxa, Kocuria kristinae, Kocuria palustris, Kocuria polaris, Kocuria rhizophila, Kocuria rosea, Kocuria varians, Nesterenkonia halobia, Nesterenkonia lacusekhoensis, Renibacterium salmoninarum, Rothia amarae, Rothia dentocariosa, Rothia mucilaginosa, Rothia nasimurium or Stomatococcus mucilaginosus; Mycobacteriaceae such as the genera Mycobacterium e.g. the species Mycobacterium africanum, Mycobacterium agri, Mycobacterium aichiense, Mycobacterium alvei, Mycobacterium asiaticum, Mycobacterium aurum, Mycobacterium austroafricanum, Mycobacterium bohemicum, Mycobacterium botniense, Mycobacterium brumae, Mycobacterium chelonae subsp. abscessus, Mycobacterium chitae, Mycobacterium chlorophenolicum, Mycobacterium chubuense, Mycobacterium confluentis, Mycobacterium cookii, Mycobacterium diemhoferi, Mycobacterium doricum, Mycobacterium duvalii, Mycobacterium fallax, Mycobacterium farcinogenes, Mycobacterium flavescens, Mycobacterium frederiksbergense, Mycobacterium gadium, Mycobacterium gilvum, Mycobacterium gordonae, Mycobacterium hassiacum, Mycobacterium hiberniae, Mycobacterium hodleri, Mycobacterium holsaticum, Mycobacterium komossense, Mycobacterium lacus, Mycobacterium madagascariense, Mycobacterium mageritense, Mycobacterium montefiorense, Mycobacterium moriokaense, Mycobacterium murale, Mycobacterium neoaurum, Mycobacterium nonchromogenicum, Mycobacterium obuense, Mycobacterium palustre, Mycobacterium parafortuitum, Mycobacterium peregrinum, Mycobacterium phlei, Mycobacterium pinnipedii, Mycobacterium poriferae, Mycobacterium pulveris, Mycobacterium rhodesiae, Mycobacterium shottsii, Mycobacterium sphagni, Mycobacterium terrae, Mycobacterium thermoresistibile, Mycobacterium tokaiense, Mycobacterium triviale, Mycobacterium tusciae or Mycobacterium vanbaalenii; Nocardiaceae such as the genera Nocardia, Rhodococcus e.g. the species Nocardia abscessus, Nocardia africana, Nocardia amarae, Nocardia asteroides, Nocardia autotrophica, Nocardia beijingensis, Nocardia brasiliensis, Nocardia brevicatena, Nocardia caishijiensis, Nocardia calcarea, Nocardia carnea, Nocardia cellulans, Nocardia cerradoensis, Nocardia coeliaca, Nocardia corynebacterioides, Nocardia crassostreae, Nocardia cummidelens, Nocardia cyriacigeorgica, Nocardia farcinica, Nocardia flavorosea, Nocardia fluminea, Nocardia globerula, Nocardia hydrocarbonoxydans, Nocardia ignorata, Nocardia mediterranei, Nocardia nova, Nocardia orientalis, Nocardia otitidis-caviarum, Nocardia otitidiscaviarum, Nocardia paucivorans, Nocardia petroleophila, Nocardia pinensis, Nocardia pseudobrasiliensis, Nocardia pseudovaccinii, Nocardia puris, Nocardia restricta, Nocardia rugosa, Nocardia salmonicida, Nocardia saturnea, Nocardia seriolae, Nocardia soli, Nocardia sulphurea, Nocardia transvalensis, Nocardia uniformis, Nocardia vaccinii, Nocardia veterana or Nocardia vinacea; Pseudomonaceae such as the genera Azomonas, Azotobacter, Cellvibrio, Chryseomonas, Flaviomonas, Lampropedia, Mesophilobacter, Morococcus, Oligella, Pseudomonas, Rhizobacter, Rugamonas, Serpens, Thermoleophilum, Xylophilus e.g. the species Azomonas agilis, Azomonas insignis, Azomonas macrocytogenes, Azotobacter agilis, Azotobacter agilis subsp. armeniae, Azotobacter armeniacus, Azotobacter beijerinckii, Azotobacter chroococcum, Azotobacter indicum, Azotobacter macrocytogenes, Azotobacter miscellum, Azotobacter nigricans subsp. nigricans, Azotobacter paspali, Azotobacter salinestris, Azotobacter sp., Azotobacter vinelandii, Flavimonas oryzihabitans, Mesophilobacter marinus, Oligella urethralis, Pseudomonas acidovorans, Pseudomonas aeruginosa, Pseudomonas agarici, Pseudomonas alcaligenes, Pseudomonas aminovorans, Pseudomonas amygdali, Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocoffigans, Pseudomonas balearica, Pseudomonas barkeri, Pseudomonas bathycetes, Pseudomonas beijerinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chloritidismutans, Pseudomonas chlororaphis, Pseudomonas cichorii, Pseudomonas citronellolis, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes subsp. konjaci, Pseudomonas pseudoalcaligenes subsp. pseudoalcaligenes, Pseudomonas pseudoflava, Pseudomonas putida, Pseudomonas putida var. naraensis,

*Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbicans, Pseudomonas ruhlandii, Pseudomonas saccharophila, Pseudomonas savastanoi, Pseudomonas savastanoi* pvar. *glycinea, Pseudomonas savastanoi* pvar. *phaseolicola, Pseudomonas solanacearum, Pseudomonas* sp., *Pseudomonas spinosa, Pseudomonas stanieri, Pseudomonas stutzeri, Pseudomonas syringae, Pseudomonas syringae* pvar. *aptata, Pseudomonas syringae* pvar. *atrofaciens, Pseudomonas syringae* pvar. *coronafaciens, Pseudomonas syringae* pvar. *delphinii, Pseudomonas syringae* pvar. *glycinea, Pseudomonas syringae* pvar. *helianthi, Pseudomonas syringae* pvar. *lachrymans, Pseudomonas syringae* pvar. *lapsa, Pseudomonas syringae* pvar. *morsprunorum, Pseudomonas syringae* pvar. *phaseolicola, Pseudomonas syringae* pvar. *primulae, Pseudomonas syringae* pvar. *syringae, Pseudomonas syringae* pvar. *tabaci, Pseudomonas syringae* pvar. *tomato, Pseudomonas syringae* subsp. *glycinea, Pseudomonas syringae* subsp. *savastanoi, Pseudomonas syringae* subsp. *syringae, Pseudomonas syzygii, Pseudomonas tabaci, Pseudomonas taeniospiralis, Pseudomonas testosteroni, Pseudomonas thermocarboxydovorans, Pseudomonas thermotolerans, Pseudomonas thivervalensis, Pseudomonas tomato, Pseudomonas trivialis, Pseudomonas veronii, Pseudomonas vesicularis, Pseudomonas viridiflava, Pseudomonas viscogena, Pseudomonas woodsii, Rhizobacter dauci, Rhizobacter daucus* or *Xylophilus ampelinus*; Rhizobiaceae such as the genera *Agrobacterium, Carbophilus, Chelatobacter, Ensifer, Rhizobium, Sinorhizobium* e.g. the species *Agrobacterium atlanticum, Agrobacterium ferrugineum, Agrobacterium gelatinovorum, Agrobacterium larrymoorei, Agrobacterium meteori, Agrobacterium radiobacter, Agrobacterium rhizogenes, Agrobacterium rubi, Agrobacterium stellulatum, Agrobacterium tumefaciens, Agrobacterium vitis, Carbophilus carboxidus, Chelatobacter heintzii, Ensifer adhaerens, Ensifer arboris, Ensifer fredii, Ensifer kostiensis, Ensifer kummerowiae, Ensifer medicae, Ensifer meliloti, Ensifer saheli, Ensifer terangae, Ensifer xinjiangensis, Rhizobium ciceri Rhizobium etli, Rhizobium fredii, Rhizobium ga/egae, Rhizobium gafficum, Rhizobium giardinii, Rhizobium hainanense, Rhizobium huakuii, Rhizobium huautlense, Rhizobium indigoferae, Rhizobium japonicum, Rhizobium leguminosarum, Rhizobium loessense, Rhizobium loti, Rhizobium lupini, Rhizobium mediterraneum, Rhizobium meliloti, Rhizobium mongolense, Rhizobium phaseoli, Rhizobium radiobacter, Rhizobium rhizogenes, Rhizobium rubi, Rhizobium sullae, Rhizobium tianshanense, Rhizobium trifolii, Rhizobium tropici, Rhizobium undicola, Rhizobium vitis, Sinorhizobium adhaerens, Sinorhizobium arboris, Sinorhizobium fredii, Sinorhizobium kostiense, Sinorhizobium kummerowiae, Sinorhizobium medicae, Sinorhizobium meliloti, Sinorhizobium morelense, Sinorhizobium saheli* or *Sinorhizobium xinjiangense*; Streptomycetaceae such as the genera *Kitasatosprora, Streptomyces, Streptoverticillium* e.g. the species *Streptomyces abikoensis, Streptomyces aburaviensis, Streptomyces achromogenes* subsp. *achromogenes, Streptomyces achromogenes* subsp. *rubradiris, Streptomyces acidiscabies, Streptomyces acrimycini, Streptomyces aculeolatus, Streptomyces afghaniensis, Streptomyces alanosinicus, Streptomyces albaduncus, Streptomyces albiaxialis, Streptomyces albidochromogenes, Streptomyces albidoflavus, Streptomyces albireticuli, Streptomyces albofaciens, Streptomyces alboflavus, Streptomyces albogriseolus, Streptomyces albolongus, Streptomyces alboniger, Streptomyces albospinus, Streptomyces albosporeus* subsp. *albosporeus, Streptomyces albosporeus* subsp. *labilomyceticus, Streptomyces alboverticillatus, Streptomyces albovinaceus, Streptomyces alboviridis, Streptomyces albulus, Streptomyces albus* subsp. *albus, Streptomyces albus* subsp. *pathocidicus, Streptomyces almquistii, Streptomyces althioticus, Streptomyces amakusaensis, Streptomyces ambofaciens, Streptomyces aminophilus, Streptomyces anandii, Streptomyces anthocyanicus, Streptomyces antibioticus, Streptomyces antimycoticus, Streptomyces anulatus, Streptomyces arabicus, Streptomyces ardus, Streptomyces arenae, Streptomyces argenteolus, Streptomyces armeniacus, Streptomyces asiaticus, Streptomyces asterosporus, Streptomyces atratus, Streptomyces atroaurantiacus, Streptomyces atroolivaceus, Streptomyces atrovirens, Streptomyces aurantiacus, Streptomyces aurantiogriseus, Streptomyces aureocirculatus, Streptomyces aureofaciens, Streptomyces aureorectus, Streptomyces aureoversilis, Streptomyces aureoverticillatus, Streptomyces aureus, Streptomyces avellaneus, Streptomyces avermectinius, Streptomyces avermitilis, Streptomyces avidinii, Streptomyces azaticus, Streptomyces azureus, Streptomyces baamensis, Streptomyces bacillaris, Streptomyces badius, Streptomyces baldaccii, Streptomyces bambergiensis, Streptomyces beijiangensis, Streptomyces bellus, Streptomyces bikiniensis, Streptomyces biverticillatus, Streptomyces blastmyceticus, Streptomyces bluensis, Streptomyces bobili, Streptomyces bottropensis, Streptomyces brasiliensis, Streptomyces bungoensis, Streptomyces cacaoi* subsp. *asoensis, Streptomyces cacaoi* subsp. *cacaoi, Streptomyces caelestis, Streptomyces caeruleus, Streptomyces californicus, Streptomyces calvus, Streptomyces canaries, Streptomyces candidus, Streptomyces canescens, Streptomyces cangkringensis, Streptomyces caniferus, Streptomyces canus, Streptomyces capillispiralis, Streptomyces capoamus, Streptomyces carpaticus, Streptomyces carpinensis, Streptomyces catenulae, Streptomyces caviscabies, Streptomyces cavourensis* subsp. *cavourensis, Streptomyces cavourensis* subsp. *washingtonensis, Streptomyces cellostaticus, Streptomyces celluloflavus, Streptomyces cellulolyticus, Streptomyces cellulosae, Streptomyces champavatii, Streptomyces chartreuses, Streptomyces chattanoogensis, Streptomyces chibaensis, Streptomyces chrestomyceticus, Streptomyces chromofuscus, Streptomyces chryseus, Streptomyces chrysomallus* subsp. *chrysomallus, Streptomyces chrysomallus* subsp. *fumigatus, Streptomyces cinereorectus, Streptomyces cinereoruber* subsp. *cinereoruber, Streptomyces cinereoruber* subsp. *fructofermentans, Streptomyces cinereospinus, Streptomyces cinereus, Streptomyces cinerochromogenes, Streptomyces cinnabarinus, Streptomyces cinnamonensis, Streptomyces cinnamoneus, Streptomyces cinnamoneus* subsp. *albosporus, Streptomyces cinnamoneus* subsp. *cinnamoneus, Streptomyces cinnamoneus* subsp. *lanosus, Streptomyces cinnamoneus* subsp. *sparsus, Streptomyces cirratus, Streptomyces ciscaucasicus, Streptomyces citreofluorescens, Streptomyces clavifer, Streptomyces clavuligerus, Streptomyces cochleatus, Streptomyces coelescens, Streptomyces coelicoflavus, Streptomyces coelicolor, Streptomyces coeruleoflavus, Streptomyces coeruleofuscus, Streptomyces coeruleoprunus, Streptomyces coeruleorubidus, Streptomyces coerulescens, Streptomyces collinus, Streptomyces colombiensis, Streptomyces corchorusii, Streptomyces costaricanus, Streptomyces cremeus, Streptomyces crystallinus, Streptomyces curacoi, Streptomyces cuspidosporus, Streptomyces cyaneofuscatus, Streptomyces cyaneus, Streptomyces cyanoalbus, Streptomyces cystargineus, Streptomyces daghestanicus, Streptomyces diastaticus* subsp. *ardesiacus, Streptomyces diastaticus* subsp. *diastaticus, Streptomyces diastatochromogenes, Streptomyces distallicus, Streptomyces djakartensis, Strepto-* myces durhamensis, Streptomyces echinatus, Streptomyces echinoruber, Streptomyces ederensis, Streptomyces ehimensis, Streptomyces endus, Streptomyces enissocaesilis, Streptomyces erumpens, Streptomyces erythraeus, Streptomyces erythrogriseus, Streptomyces eurocidicus, Streptomyces europaeiscabiei, Streptomyces eurythermus, Streptomyces exfoliates, Streptomyces felleus, Streptomyces fervens, Streptomyces fervens subsp. fervens, Streptomyces fervens subsp. melrosporus, Streptomyces filamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flaviscleroticus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatiscleroticus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces Streptomyces glaucescens, Streptomyces glaucosporus, Streptomyces glaucus, Streptomyces globisporus subsp. caucasicus, Streptomyces globisporus subsp. flavofuscus, Streptomyces globisporus subsp. globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocarneus, Streptomyces griseochromogenes, Streptomyces griseoflavus, Streptomyces griseofuscus, Streptomyces griseoincarnatus, Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces griseoverticillatus, Streptomyces griseoviridis, Streptomyces griseus subsp. alpha, Streptomyces griseus subsp. cretosus, Streptomyces griseus subsp. griseus, Streptomyces griseus subsp. solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus subsp. angustmyceticus, Streptomyces hygroscopicus subsp. decoyicus, Streptomyces hygroscopicus subsp. glebosus, Streptomyces hygroscopicus subsp. hygroscopicus, Streptomyces hygroscopicus subsp. ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae subsp. grasserius, Streptomyces lavendulae subsp. lavendulae, Streptomyces lavenduligriseus, Streptomyces lavendulocolor, Streptomyces levis, Streptomyces libani subsp. libani, Streptomyces libani subsp. rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces matensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporeus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli subsp. cellulophilus, Streptomyces olivoreticuli subsp. olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramulosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus subsp. paromomycinus, Streptomyces rimosus subsp. rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, *Streptomyces rubiginosohelvolus, Streptomyces rubiginosus, Streptomyces rubrogriseus, Streptomyces rutgersensis* subsp. *castelarensis, Streptomyces rutgersensis* subsp. *rutgersensis, Streptomyces salmonis, Streptomyces sampsonii, Streptomyces sanglieri, Streptomyces sannanensis, Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces the rmodiastaticus, Streptomyces thermogriseus, Streptomyces thermolineatus, Streptomyces thermonitrificans, Streptomyces thermospinosisporus, Streptomyces thermoviolaceus* subsp. *apingens, Streptomyces thermoviolaceus* subsp. *thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vinaceus, Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticillium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium b/astmyceticum, Streptoverticillium cinnamoneum* subsp. *albosporum, Streptomyces cinnamoneus* subsp. *albosporus, Streptoverticillium cinnamoneum* subsp. *cinnamoneum, Streptoverticillium cinnamoneum* subsp. *lanosum, Streptoverticillium cinnamoneum* subsp. *sparsum, Streptoverticillium distafficum, Streptoverticillium ehimense, Streptoverticillium eurocidicum, Streptoverticillium fervens* subsp. *fervens, Streptoverticillium fervens* subsp. *melrosporus, Streptoverticillium flavopersicum, Streptoverticillium griseocarneum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli* subsp. *cellulophilum, Streptoverticillium olivoreticuli* subsp. *olivoreticuli, Streptoverticillium olivoreticulum, Streptoverticillium olivoreticulum* subsp. *cellulophilum, Streptoverticillium olivoverticillatum, Streptoverticillium orinoci, Streptoverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptoverticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum.*

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida boidinii, Candida bombicola, Candida cylindracea, Candida parapsilosis, Candida rugosa, Candida tropicalis, Pichia methanolica* and *Pichia pastoris.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elaeis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticiffiflorum, Sorghum vulgare, Holcus halepensis, Sorghum miliaceum* millet, *Panicum militaceum [Sorghum, millet], Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia [macadamia]*; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can in princible also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana*. Fabaceae such as the genera *Glycine* e.g. the species *Glycine max, Soja hispida* or *Soja max* [soybean] (wobei ich nicht sicher bin, ob es Soja max überhaupt gibt, die heißt eigentlich *Glycine max*). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor [Sorghum*, millet], *Oryza sativa, Oryza latifolia* [rice], *Zea mays* [corn, maize]*Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum, Lycopersicon pyriforme, Solanum integrifolium* or *Solanum lycopersicum* [tomato].

All abovementioned organisms can in princible also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either
a) a nucleic acid sequence as indicated in Table I, columns 5 or 7, lines 1 to 5 and/or lines 334 to 338, or a derivative thereof, or
b) a genetic regulatory element, for example a promoter, which is functionally linked to the nucleic acid sequence as indicated in Table I, columns 5 or 7, lines 1 to 5 and/or lines 334 to 338, or a derivative thereof, or
c) (a) and (b)
is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The respective fine chemical, which is synthesized in the organism, in particular the microorganism, the cell, the tissue or the plant, of the invention can be isolated if desired. Depending on the use of the respective fine chemical, different purities resulting from the purification may be advantageous as will be described herein below.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine.

In one embodiment, after an activity of a polypeptide of the present invention or used in the process of the present invention has been increased or generated, or after the expression of a nucleic acid molecule or polypeptide according to the invention has been generated or increased, the transgenic plant generated can be grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure respective fine chemical or chemically pure compositions comprising the respective fine chemical may also be produced by the process described above. To this end, the respective fine chemical or the compositions are isolated in the known manner from an organism according to the invention, such as the microorganisms, non-human animal or the plants, and/or their culture medium in which or on which the organisms had been grown. These chemically pure respective fine chemical or said compositions are advantageous for applications in the field of the food industry, the cosmetics industry or the pharmaceutical industry.

Thus, the content of plant components and preferably also further impurities is as low as possible, and the abovementioned respective fine chemical is obtained in as pure form as possible. In these applications, the content of plant components advantageously amounts to less than 10%, preferably 1%, more preferably 0.1%, very especially preferably 0.01% or less.

Accordingly, the respective fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the respective fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found a tissue, more preferred in an organism or in a harvestable part thereof.

In principle, the respective fine chemicals produced can be increased in two ways by the process according to the invention. The pool of free respective fine chemicals, in particular of the free respective fine chemical, and/or the content of protein-bound respective fine chemicals, in particular of the protein-bound respective fine chemical may advantageously be increased.

It may be advantageous to increase the pool of free amino acids in the transgenic organisms by the process according to the invention in order to isolate high amounts of the pure respective fine chemical.

In another preferred embodiment of the invention a combination of the increased expression of the nucleic acid sequence or the protein of the invention together with the transformation of a protein or polypeptid, which functions as a sink for the desired amino acid for example methionine, lysine or threonine in the organism is useful to increase the production of the respective fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670,635). Galili et al., Transgenic Res. 2000 showed, that enhancing the synthesis of threonine by a feed back insensitive aspartate kinase did not lead only to in increase in free threonine but also in protein bound threonine.

In may also be advantageous to increase the content of the protein-bound respective fine chemical.

In a preferred embodiment, the respective fine chemical (methionine) and/or threonine are produced in accordance with the invention and, if desired, are isolated. The production of further amino acids such as lysine and of amino acid mixtures by the process according to the invention is advantageous.

In the case of the fermentation of microorganisms, the abovementioned amino acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamid resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acide. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews M J, 1997 (Lysine, threonine and methionine biosynthesis. In BK Singh, ed, Plant Amino Acids: Biochemistry and Biotechnology. Dekker, New York, pp 205-225; H Hesse and R Hoefgen. (2003) Molecular aspects of methionine biosynthesis. TIPS 8(259-262.

In a preferred embodiment, the present invention relates to a process for the production of the respective fine chemical comprising or generating in an organism or a part thereof the expression of at least one nucleic acid molecule comprising a nucleic acid molecule selected from the group consisting of:
a) nucleic acid molecule encoding, preferably at least the mature form, of a polypeptide having a sequence as indicated in Table II, columns 5 or 7, lines 1 to 5 and/or lines 334 to 338, or a fragment thereof, which confers an increase in the amount of the respective fine chemical in an organism or a part thereof;
b) nucleic acid molecule comprising, preferably at least the mature form, of a nucleic acid molecule having a sequence as indicated in Table I, columns 5 or 7, lines 1 to 5 and/or lines 334 to 338;
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybridizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying nucleic acid molecules from a cDNA library or a genomic library using the primers pairs having a sequence as indicated in Table III, columns 7, lines 1 to 5 and/or lines 334 to 338, and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;

j) nucleic acid molecule which encodes a polypeptide comprising the consensus sequence having a sequences as indicated in Table IV, columns 7, lines 1 to 5 and/or lines 334 to 338, and conferring an increase in the amount of the respective fine chemical in an organism or a part thereof;

k) nucleic acid molecule comprising one or more of the nucleic acid molecule encoding the amino acid sequence of a polypeptide encoding a domain of a polypeptide indicated in Table II, columns 5 or 7, lines 1 to 5 and/or lines 334 to 338, and conferring an increase in the amount of the respective fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in Table IA, columns 5 or 7, lines 1 to 5 and/or lines 334 to 338, by one or more nucleotides. In one embodiment, the nucleic acid molecule used in the process of the invention does not consist of the sequence shown in indicated in Table IA, columns 5 or 7, lines 1 to 5 and/or lines 334 to 338: In one embodiment, the nucleic acid molecule used in the process of the invention is less than 100%, 99.999%, 99.99%, 99.9% or 99% identical to a sequence indicated in Table IA, columns 5 or 7, lines 1 to 5 and/or lines 334 to 338. In another embodiment, the nucleic acid molecule does not encode a polypeptide of a sequence indicated in Table IIA, columns 5 or 7, lines 1 to 5 and/or lines 334 to 338.

In one embodiment, the nucleic acid molecule used in the process of the invention distinguishes over the sequence indicated in Table IB, columns 5 or 7, lines 1 to 5 and/or lines 334 to 338, by one or more nucleotides. In one embodiment, the nucleic acid molecule used in the process of the invention does not consist of the sequence shown in indicated in Table IB, columns 5 or 7, lines 1 to 5 and/or lines 334 to 338: In one embodiment, the nucleic acid molecule used in the process of the invention is less than 100%, 99.999%, 99.99%, 99.9% or 99% identical to a sequence indicated in Table IB, columns 5 or 7, lines 1 to 5 and/or lines 334 to 338. In another embodiment, the nucleic acid molecule does not encode a polypeptide of a sequence indicated in Table IIB, columns 5 or 7, lines 1 to 5 and/or lines 334 to 338.

In one embodiment, the nucleic acid molecule of the invention or used in the process of the invention distinguishes over the sequence indicated in Table I, columns 5 or 7, lines 1 to 5 and/or lines 334 to 338, by one or more nucleotides. In one embodiment, the nucleic acid molecule of the invention or the nucleic acid used in the process of the invention does not consist of the sequence shown in indicated in Table I, columns 5 or 7, lines 1 to 5 and/or lines 334 to 338: In one embodiment, the nucleic acid molecule of the present invention is less than 100%, 99.999%, 99.99%, 99.9% or 99% identical to a sequence indicated in Table I, columns 5 or 7, lines 1 to 5 and/or lines 334 to 338. In another embodiment, the nucleic acid molecule does not encode a polypeptide of a sequence indicated in Table II, columns 5 or 7, lines 1 to 5 and/or lines 334 to 338.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, The terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as indicated in Table I, columns 5 or 7, lines 1 to 5 and/or lines 334 to 338, nucleic acid molecules which are derived from a amino acid sequences as indicated in Table II, columns 5 or 7, lines 1 to 5 and/or lines 334 to 338 or from polypeptides comprising the consensus sequence as indicated in Table IV, columns 7, lines 1 to 5 and/or lines 334 to 338, or their derivatives or homologues encoding polypeptides with the enzymatic or biological activity of a polypeptide as indicated in Table II, column 3, 5 or 7, lines 1 to 5 and/or lines 334 to 338 or e.g. conferring a increase of the respective fine chemical after increasing its expression or activity are advantageously increased in the process according to the invention.

In one embodiment, said sequences are cloned into nucleic acid constructs, either individually or in combination. These nucleic acid constructs enable an optimal synthesis of the respective fine chemical produced in the process according to the invention.

Nucleic acid molecules, which are advantageous for the process according to the invention and which encode polypeptides with an activity of a polypeptide of the invention or the polypeptide used in the method of the invention or used in the process of the invention, e.g. of a protein as indicated in Table II, column 5, lines 1 to 5 and/or lines 334 to 338 or being encoded by a nucleic acid molecule indicated in Table I, column 5, lines 1 to 5 and/or lines 334 to 338 or of its homologs, e.g. as indicated in Table II, column 7, lines 1 to 5 and/or lines 334 to 338, can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Chemy J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with an activity of a polypeptide as indicated in Table I, column3, lines 1 to 5 and/or lines 334 to 338 or having the sequence of a polypeptide as indicated in Table II, columns 5 and 7, lines 1 to 5 and/or lines 334 to 338 and conferring an increase of the respective fine chemical.

The nucleic acid sequence(s) used in the process for the production of the respective fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the respective fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the respective fine chemical produced in the process according to the invention. This improved production, or production efficiency, of the respective fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum gran-*

*diflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis.*

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species *Saccharomyces cerevisiae* for the production of the respective fine chemical in microorganism.

The skilled worker knows other suitable sources for the production of respective fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida.*

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

However, it is also possible to use artificial sequences, which differ in one or more bases from the nucleic acid sequences found in organisms, or in one or more amino acid molecules from polypeptide sequences found in organisms, in particular from the polypeptide sequences indicated in Table II, columns 5 or 7, lines 1 to 5 and/or lines 334 to 338 or the functional homologues thereof as described herein, preferably conferring above-mentioned activity, i.e. conferring a increase of the respective fine chemical after increasing its activity.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as the pairs indicated in Table III, columns 7, lines 1 to 5 and/or lines 334 to 338, by means of polymerase chain reaction can be generated on the basis of a sequence shown herein, for example the sequence as indicated in Table I, columns 5 or 7, lines 1 to 5 and/or lines 334 to 338 or the sequences derived from sequences as indicated in Table II, columns 5 or 7, lines 1 to 5 and/or lines 334 to 338.

Moreover, it is possible to identify conserved regions from various organisms by carrying out protein sequence alignments with the polypeptide used in the process of the invention, in particular with sequences of the polypeptide of the invention or the polypeptide used in the method of the invention, from which conserved regions, and in turn, degenerate primers can be derived. Conserved region for the polypeptide of the invention or the polypeptide used in the method of the invention are indicated in the alignments shown in the figures. Conserved regions are those, which show a very little variation in the amino acid sequence in one particular position of several homologs from different origin. The consensus sequences indicated in Table IV, columns 7, lines 1 to 5 and/or lines 334 to 338 are derived from said alignments.

Degenerated primers can then be utilized by PCR for the amplification of fragments of novel proteins having above-mentioned activity, e.g. conferring the increase of the respective fine chemical after increasing its expression or activity or further functional homologs of the polypeptide of the invention or the polypeptide used in the method of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown herein below:
(1) Hybridization conditions can be selected, for example, from the following conditions:
a) 4×SSC at 65° C.,
b) 6×SSC at 45° C.,
c) 6×SSC, 100 mg/ml denatured fragmented fish sperm DNA at 68° C.,
d) 6×SSC, 0.5% SDS, 100 mg/ml denatured salmon sperm DNA at 68° C.,
e) 6×SSC, 0.5% SDS, 100 mg/ml denatured fragmented salmon sperm DNA, 50% formamide at 42° C.,
f) 50% formamide, 4×SSC at 42° C.,
g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
h) 2× or 4×SSC at 50° C. (low-stringency condition), or
i) 30 to 40% formamide, 2× or 4×SSC at 42° C. (low-stringency condition).
(2) Wash steps can be selected, for example, from the following conditions:
a) 0.015 M NaCl/0.0015 M sodium citrate/0.1% SDS at 50° C.
b) 0.1×SSC at 65° C.
c) 0.1×SSC, 0.5% SDS at 68° C.
d) 0.1×SSC, 0.5% SDS, 50% formamide at 42° C.
e) 0.2×SSC, 0.1% SDS at 42° C.
f) 2×SSC at 65° C. (low-stringency condition).

Polypeptides having above-mentioned activity, i.e. conferring the respective fine chemical increase, derived from other organisms, can be encoded by other DNA sequences which hybridize to a sequences indicated in Table I, columns 5 or 7, lines 1 to 5 and/or lines 334 to 338, preferably of Table I B, columns 5 or 7, lines 1 to 5 and/or lines 334 to 338 under relaxed hybridization conditions and which code on expression for peptides having the methionine increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the respective fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridising with the nucleic acid molecule of the invention or the nucleic acid molecule used in the method of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the respective fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences indicated in Table I, columns 5 or 7, lines 1 to 5 and/or lines 334 to 338, preferably of Table I B, columns 5 or 7, lines 1 to 5 and/or lines 334 to 338 is one which is sufficiently complementary to one of said nucleotide sequences such that it can hybridize to one of said nucleotide sequences thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence indicated in Table I, columns 5 or 7, lines 1 to 5 and/or lines 334 to 338, preferably of Table I B, columns 5 or 7, lines 1 to 5 and/or lines 334 to 338, or a functional portion thereof and preferably has above mentioned activity, in particular has the-fine-chemical-increasing activity after increasing its activity or an activity of a product of a gene encoding said sequence or its homologs.

The nucleic acid molecule of the invention or the nucleic acid molecule used in the method of the invention comprises a nucleotide sequence which hybridises, preferably hybridises under stringent conditions as defined herein, to one of the nucleotide sequences indicated in Table I, columns 5 or 7, lines 1 to 5 and/or lines 334 to 338, preferably of Table I B, columns 5 or 7, lines 1 to 5 and/or lines 334 to 338 or a portion thereof and encodes a protein having above-mentioned activity and as indicated in indicated in Table II, columns 5 or 7, lines 1 to 5 and/or lines 334 to 338, preferably of Table II B, columns 5 or 7, lines 1 to 5 and/or lines 334 to 338, e.g. conferring an increase of the respective fine chemical.

Optionally, the nucleotide sequence, which hybridises to one of the nucleotide sequences indicated in Table I, columns 5 or 7, lines 1 to 5 and/or lines 334 to 338, preferably of Table I B, columns 5 or 7, lines 1 to 5 and/or lines 334 to 338 has further one or more of the activities annotated or known for the a protein as indicated in Table II, column 3, lines 1 to 5 and/or lines 334 to 338, preferably of Table II B, columns 3, lines 1 to 5 and/or lines 334 to 338.

Moreover, the nucleic acid molecule of the invention or used in the process of the invention can comprise only a portion of the coding region of one of the sequences indicated in Table I, columns 5 or 7, lines 1 to 5 and/or lines 334 to 338, preferably of Table I B, columns 5 or 7, lines 1 to 5 and/or lines 334 to 338, for example a fragment which can be used as a probe or primer or a fragment encoding a biologically active portion of the polypeptide of the present invention or of a polypeptide used in the process of the present invention, i.e. having above-mentioned activity, e.g. conferring an increase of methionine if its activity is increased. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences indicated in Table I, columns 5 or 7, lines 1 to 5 and/or lines 334 to 338, an anti-sense sequence of one of the sequences indicated in Table I, columns 5 or 7, lines 1 to 5 and/or lines 334 to 338, or naturally occurring mutants thereof. Primers based on a nucleotide sequence of the invention can be used in PCR reactions to clone homologues of the polypeptide of the invention or of the polypeptide used in the process of the invention, e.g. as the primers described in the examples of the present invention, e.g. as shown in the examples. A PCR with the primer pairs indicated in Table III, column 7, lines 1 to 5 and/or lines 334 to 338 will result in a fragment of a polynucleotide sequence as indicated in Table I, columns 5 or 7, lines 1 to 5 and/or lines 334 to 338. Preferred is Table II B, columns 7, lines 1 to 5 and/or lines 334 to 338.

Primer sets are interchangeable. The person skilled in the art knows to combine said primers to result in the desired product, e.g. in a full-length clone or a partial sequence.

Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention or the nucleic acid molecule used in the method of the invention encodes a polypeptide or portion thereof which includes an amino acid sequence which is sufficiently homologous to an amino acid sequence as indicated in Table II, columns 5 or 7, lines 1 to 5 and/or lines 334 to 338 such that the protein or portion thereof maintains the ability to participate in the respective fine chemical production, in particular a methionine increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as indicated in Table II, columns 5 or 7, lines 1 to 5 and/or lines 334 to 338 such that the protein or portion thereof is able to participate in the increase of the respective fine chemical production. In one embodiment, a protein or portion thereof as indicated in Table II, columns 5 or 7, lines 1 to 5 and/or lines 334 to 338 has for example an activity of a polypeptide indicated in Table II, column 3, lines 1 to 5 and/or lines 334 to 338.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence as indicated in Table II, columns 5 or 7, lines 1 to 5 and/or lines 334 to 338 and has above-mentioned activity, e.g. conferring preferably the increase of the respective fine chemical.

Portions of proteins encoded by the nucleic acid molecule of the invention or the nucleic acid molecule used in the method of the invention are preferably biologically active, preferably having above-mentioned annotated activity, e.g. conferring a increase the respective fine chemical after increase of activity.

As mentioned herein, the term "biologically active portion" is intended to include a portion, e.g., a domain/motif, that confers increase of the respective fine chemical or has an immunological activity such that it is binds to an antibody binding specifically to the polypeptide of the present invention or a polypeptide used in the process of the present invention for producing the respective fine chemical;

The invention further relates to nucleic acid molecules that differ from one of the nucleotide sequences indicated in Table I, columns 5 or 7, lines 1 to 5 and/or lines 334 to 338 (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides comprising the consensus sequences as indicated in Table IV, columns 5 or 7, lines 1 to 5 and/or lines 334 to 338 or of the polypeptide as indicated in Table II, columns 5 or 7, lines 1 to 5 and/or lines 334 to 338 or their functional homologues. Advantageously, the nucleic acid molecule of the invention or the nucleic acid molecule used in the method of the invention comprises, or in an other embodiment has, a nucleotide sequence encoding a protein comprising, or in an other embodiment having, a consensus sequences as indicated in Table IV, columns 5 or 7, lines 1 to 5 and/or lines 334 to 338 or of the polypeptide as indicated in Table II, columns 5 or 7, lines 1 to 5 and/or lines 334 to 338 or the functional homologues. In a still further embodiment, the nucleic acid molecule of the invention or the nucleic acid molecule used in the method of the invention encodes a full length protein which is substantially homologous to an amino acid sequence comprising a consensus sequence as indicated in Table IV, columns 5 or 7, lines 1 to 5 and/or lines 334 to 338 or of a polypeptide as indicated in Table II, columns 5 or 7, lines 1 to 5 and/or lines 334 to 338 or the functional homologues thereof. However, in a preferred embodiment, the nucleic acid molecule of the present invention does not consist of a sequence as indicated in Table I, columns 5 or 7, lines 1 to 5 and/or lines 334 to 338, preferably as indicated in Table I A, columns 5 or 7, lines 1 to 5 and/or lines 334 to 338. Preferably the nucleic acid molecule of the invention is a functional homologue or identical to a nucleic acid molecule indicated in Table I B, columns 5 or 7, lines 1 to 5 and/or lines 334 to 338.

In addition, it will be appreciated by those skilled in the art that DNA sequence polymorphisms that lead to changes in the amino acid sequences may exist within a population. Such genetic polymorphism in the gene encoding the polypeptide of the invention or the polypeptide used in the method of the invention or comprising the nucleic acid molecule of the invention or the nucleic acid molecule used in the method of the invention may exist among individuals within a population due to natural variation.

As used herein, the terms "gene" and "recombinant gene" refer to nucleic acid molecules comprising an open reading frame encoding the polypeptide of the invention or the polypeptide used in the method of the invention or comprising the nucleic acid molecule of the invention or the nucleic acid molecule used in the method of the invention or encoding the polypeptide used in the process of the present invention, preferably from a crop plant or from a microorganism useful for the production of respective fine chemicals, in particular for the production of the respective fine chemical. Such natural variations can typically result in 1-5% variance in the nucleotide sequence of the gene. Any and all such nucleotide variations and resulting amino acid polymorphisms in genes encoding a polypeptide of the invention or the polypeptide used in the method of the invention or comprising a the nucleic acid molecule of the invention or the nucleic acid molecule used in the method of the invention that are the result of natural variation and that do not alter the functional activity as described are intended to be within the scope of the invention.

Nucleic acid molecules corresponding to natural variants homologues of a nucleic acid molecule of the invention or the nucleic acid molecule used in the method of the invention, which can also be a cDNA, can be isolated based on their homology to the nucleic acid molecules disclosed herein using the nucleic acid molecule of the invention or the nucleic acid molecule used in the method of the invention, or a portion thereof, as a hybridization probe according to standard hybridization techniques under stringent hybridization conditions.

Accordingly, in another embodiment, a nucleic acid molecule of the invention or the nucleic acid molecule used in the method of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising a sequence as indicated in Table I, columns 5 or 7, lines 1 to 5 and/or lines 334 to 338. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, the nucleic acid molecule of the invention or the nucleic acid molecule used in the method of the invention that hybridizes under stringent conditions to a sequence as indicated in Table I, columns 5 or 7, lines 1 to 5 and/or lines 334 to 338 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of an protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. as indicated in Table I, columns 5 or 7, lines 1 to 5 and/or lines 334 to 338.

A "non-essential" amino acid residue is a residue that can be altered from the wild-type sequence of one without altering the activity of said polypeptide, whereas an "essential" amino acid residue is required for an activity as mentioned above, e.g. leading to an increase in the respective fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organism can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned activity, e.g. conferring an increase in the respective fine chemical in an organisms or parts thereof that contain changes in amino acid residues that are not essential for said activity. Such polypeptides differ in amino acid sequence from a sequence contained in a sequence as indicated in Table II, columns 5 or 7, lines 1 to 5 and/or lines 334 to 338, preferably of Table II B, column 7, lines 1 to 5 and/or lines 334 to 338 yet retain said activity described herein. The nucleic acid molecule can comprise a nucleotide sequence encoding a polypeptide, wherein the polypeptide comprises an amino acid sequence at least about 50% identical to an amino acid sequence as indicated in Table II, columns 5 or 7, lines 1 to 5 and/or lines 334 to 338, preferably of Table II B, column 7, lines 1 to 5 and/or lines 334 to 338 and is capable of participation in the increase of production of the respective fine chemical after increasing its activity, e.g. its expression. Preferably, the protein encoded by the nucleic acid molecule is at least about 60% identical to a sequence as indicated in Table II, columns 5 or 7, lines 1 to 5 and/or lines 334 to 338, preferably of Table II B, column 7, lines 1 to 5 and/or lines 334 to 338, more preferably at least about 70% identical to one of the sequences as indicated in Table II, columns 5 or 7, lines 1 to 5 and/or lines 334 to 338, preferably of Table II B, column 7, lines 1 to 5 and/or lines 334 to 338, even more preferably at least about 80%, 90%, or 95% homologous to a sequence as indicated in Table II, columns 5 or 7, lines 1 to 5 and/or lines 334 to 338, preferably of Table II B, column 7, lines 1 to 5 and/or lines 334 to 338, and most preferably at least about 96%, 97%, 98%, or 99% identical to the sequence as indicated in Table II, columns 5 or 7, lines 1 to 5 and/or lines 334 to 338, preferably of Table II B, column 7, lines 1 to 5 and/or lines 334 to 338.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=-3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -l Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence which has a 80% homology with sequence SEQ ID NO: 1 at the nucleic acid level is understood as meaning a sequence which, upon comparison with the sequence SEQ ID NO: 1 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2,912 | Average mismatch: | −2,003 |

For example a sequence which has a 80% homology with sequence SEQ ID NO: 2 at the protein level is understood as meaning a sequence which, upon comparison with the sequence SEQ ID NO: 2 by the above program algorithm with the above parameter set, has a 80% homology.

Functional equivalents derived from one of the polypeptides as indicated in Table II, columns 5 or 7, lines 1 to 5 and/or lines 334 to 338 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table II, columns 5 or 7, lines 1 to 5 and/or lines 334 to 338 according to the invention and are distinguished by essentially the same properties as a polypeptide as indicated in Table II, columns 5 or 7, lines 1 to 5 and/or lines 334 to 338.

Functional equivalents derived from a nucleic acid sequence as indicated in Table I, columns 5 or 7, lines 1 to 5 and/or lines 334 to 338, preferably of Table I B, column 7, lines 1 to 5 and/or lines 334 to 338 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of a polypeptide as indicated in Table II, columns 5 or 7, lines 1 to 5 and/or lines 334 to 338 according to the invention and encode polypeptides having essentially the same properties as a polypeptide as indicated in Table II, columns 5 or 7, lines 1 to 5 and/or lines 334 to 338, preferably of Table II B, column 7, lines 1 to 5 and/or lines 334 to 338.

"Essentially the same properties" of a functional equivalent is above all understood as meaning that the functional equivalent has above mentioned activity, e.g. conferring an increase in the respective fine chemical amount while increasing the amount of protein, activity or function of said functional equivalent in an organism, e.g. a microorganism, a plant or plant or animal tissue, plant or animal cells or a part of the same.

A nucleic acid molecule encoding a homologous to a protein sequence of as indicated in Table II, columns 5 or 7, lines 1 to 5 and/or lines 334 to 338, preferably of Table II B, column 7, lines 1 to 5 and/or lines 334 to 338 can be created by introducing one or more nucleotide substitutions, additions or deletions into a nucleotide sequence of the nucleic acid molecule of the present invention, in particular as indicated in Table I, columns 5 or 7, lines 1 to 5 and/or lines 334 to 338 such that one or more amino acid substitutions, additions or deletions are introduced into the encoded protein. Mutations can be introduced into the encoding sequences for example into sequences as indicated in Table I, columns 5 or 7, lines 1 to 5 and/or lines 334 to 338 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the respective fine chemical.

Following mutagenesis of one of the sequences shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with a sequence as indicated in Table I, columns 5 or 7, lines 1 to 5 and/or lines 334 to 338, preferably of Table I B, column 7, lines 1 to 5 and/or lines 334 to 338, or of the nucleic acid sequences derived from a sequences as indicated in Table II, columns 5 or 7, lines 1 to 5 and/or lines 334 to 338, preferably of Table II B, column 7, lines 1 to 5 and/or lines 334 to 338, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from a sequence as indicated in Table I, columns 5 or 7, lines 1 to 5 and/or lines 334 to 338, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises one or more sequences as indicated in Table I, columns 5 or 7, lines 1 to 5 and/or lines 334 to 338, preferably of Table I B, column 7, lines 1 to 5 and/or lines 334 to 338. In one embodiment, it is preferred that the nucleic acid molecule comprises as little as possible other nucleotide sequences not shown in any one of sequences as indicated in Table I, columns 5 or 7, lines 1 to 5 and/or lines 334 to 338, preferably of Table I B, column 7, lines 1 to 5 and/or lines 334 to 338. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, a nucleic acid molecule used in the process of the invention is identical to a sequences as indicated in Table I, columns 5 or 7, lines 1 to 5 and/or lines 334 to 338, preferably of Table I B, column 7, lines 1 to 5 and/or lines 334 to 338.

Also preferred is that one or more nucleic acid molecule(s) used in the process of the invention encode a polypeptide comprising a sequence as indicated in Table II, columns 5 or 7, lines 1 to 5 and/or lines 334 to 338, preferably of Table II B, column 7, lines 1 to 5 and/or lines 334 to 338. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment, the encoded polypeptide used in the process of the invention is identical to the sequences as indicated in Table II, columns 5 or 7, lines 1 to 5 and/or lines 334 to 338, preferably of Table II B, column 7, lines 1 to 5 and/or lines 334 to 338.

In one embodiment, the nucleic acid molecule of the invention or used in the process encodes a polypeptide comprising a sequence as indicated in Table II, columns 5 or 7, lines 1 to 5 and/or lines 334 to 338, preferably of Table II B, column 7, lines 1 to 5 and/or lines 334 to 338 comprises less than 100 further nucleotides. In a further embodiment, said nucleic acid molecule comprises less than 30 further nucleotides. In one embodiment, the nucleic acid molecule used in the process is identical to a coding sequence encoding a sequences as indicated in Table II, columns 5 or 7, lines 1 to 5 and/or lines 334 to 338, preferably of Table II B, column 7, lines 1 to 5 and/or lines 334 to 338.

Polypeptides (=proteins), which still have the essential enzymatic activity of the polypeptide of the present invention conferring an increase of the respective fine chemical i.e.

whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as indicated in Table II, columns 5 or 7, lines 1 to 5 and/or lines 334 to 338, preferably compared to a sequence as indicated in Table II, column 3 and 5, lines 1 to 5 and/or lines 334 to 338, and expressed under identical conditions. In one embodiment, the polypeptide of the invention is a homolog consisting of or comprising the sequence as indicated in Table II B, columns 7, lines 1 to 5 and/or lines 334 to 338.

Homologues of a sequence as indicated in Table I, columns 5 or 7, lines 1 to 5 and/or lines 334 to 338 or of a derived sequence as indicated in Table II, columns 5 or 7, lines 1 to 5 and/or lines 334 to 338 also mean truncated sequences, cDNA, single-stranded DNA or RNA of the coding and non-coding DNA sequence. Homologues of said sequences are also understood as meaning derivatives, which comprise non-coding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3' regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound respective fine chemical produced by the selected mutated organisms or parts thereof.

The organisms or part thereof produce according to the herein mentioned process of the invention an increased level of free and/or -bound respective fine chemical compared to said control or selected organisms or parts thereof.

In one embodiment, the organisms or part thereof produce according to the herein mentioned process of the invention an increased level of protein-bound respective fine chemical compared to said control or selected organisms or parts thereof.

Advantageously the selected organisms are mutagenized according to the invention. According to the invention mutagenesis is any change of the genetic information in the genome of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the respective fine chemical production.

The genes of the invention can also be activated by mutagenesis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagenesis as well as the respective agens is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, λplac etc.

Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagenesis with N-methyl-N-nitro-nitroso-guanidine.

Other biological method are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungi, a yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention originate from bacteria, for example from Proteobacteria, in particular from Gammaproteobacteria, more preferred from Enterobacteriales, e.g. from the family Enterobacteriaceae, particularly from genera *Escherichia, Salmonella, Klebsiella*, advantageously form the species *Escherichia coli* K12.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; Glycine max*; sunflower linseed or maize or their homologues.

Accordingly, in one embodiment, the invention relates to a nucleic acid molecule which comprises a nucleic acid molecule selected from the group consisting of:

a) nucleic acid molecule encoding, preferably at least the mature form, of a polypeptide as indicated in Table II, columns 5 or 7, lines 1 to 5 and/or lines 334 to 338, preferably of Table II B, column 7, lines 1 to 5 and/or lines 334 to 338; or a fragment thereof conferring an increase in the amount of the respective fine chemical in an organism or a part thereof b) nucleic acid molecule comprising, preferably at least the mature form, of a nucleic acid molecule as indicated in Table I, columns 5 or 7, lines 1 to 5 and/or lines 334 to 338, preferably of Table I B, column 7, lines 1 to 5 and/or lines 334 to 338 or a fragment thereof conferring an increase in the amount of the respective fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybridizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying a cDNA library or a genomic library using primers or primer pairs as indicated in Table III, column 7, lines 1 to 5 and/or lines 334 to 338 and conferring an increase in the amount of the respective fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the respective fine chemical in an organism or a part thereof;

j) nucleic acid molecule which encodes a polypeptide comprising a consensus sequence as indicated in Table IV, columns 7, lines 1 to 5 and/or lines 334 to 338 and conferring an increase in the amount of the respective fine chemical in an organism or a part thereof;

k) nucleic acid molecule encoding the amino acid sequence of a polypeptide encoding a domain of a polypeptide as indicated in Table II, columns 5 or 7, lines 1 to 5 and/or lines 334 to 338, preferably of Table II B, column 7, lines 1 to 5 and/or lines 334 to 338 and conferring an increase in the amount of the respective fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of a nucleic acid molecule as indicated in Table I, columns 5 or 7, lines 1 to 5 and/or lines 334 to 338, preferably of Table I B, column 7, lines 1 to 5 and/or lines 334 to 338 or a nucleic acid molecule encoding, preferably at least the mature form of, the polypeptide as indicated in Table II, columns 5 or 7, lines 1 to 5 and/or lines 334 to 338, preferably of Table II B, column 7, lines 1 to 5 and/or lines 334 to 338, and conferring an increase in the amount of the respective fine chemical in an organism or a part thereof;

or which encompasses a sequence which is complementary thereto; whereby, preferably, the nucleic acid molecule according to (a) to (l) distinguishes over the sequence indicated in Table IA or I B, columns 5 or 7, lines 1 to 5 and/or lines 334 to 338, by one or more nucleotides. In one embodiment, the nucleic acid molecule does not consist of the sequence shown and indicated in Table I A or I B, columns 5 or 7, lines 1 to 5 and/or lines 334 to 338: In one embodiment, the nucleic acid molecule is less than 100%, 99.999%, 99.99%, 99.9% or 99% identical to a sequence indicated in Table I A or I B, columns 5 or 7, lines 1 to 5 and/or lines 334 to 338. In another embodiment, the nucleic acid molecule does not encode a polypeptide of a sequence indicated in Table II A or II B, columns 5 or 7, lines 1 to 5 and/or lines 334 to 338. In an other embodiment, the nucleic acid molecule of the present invention is at least 30%, 40%, 50%, or 60% identical and less than 100%, 99.999%, 99.99%, 99.9% or 99% identical to a sequence indicated in Table I A or I B, columns 5 or 7, lines 1 to 5 and/or lines 334 to 338. In a further embodiment the nucleic acid molecule does not encode a polypeptide sequence as indicated in Table II A or II B, columns 5 or 7, lines 1 to 5 and/or lines 334 to 338. Accordingly, in one embodiment, the nucleic acid molecule of the differs at least in one or more residues from a nucleic acid molecule indicated in Table I A or I B, columns 5 or 7, lines 1 to 5 and/or lines 334 to 338. Accordingly, in one embodiment, the nucleic acid molecule of the present invention encodes a polypeptide, which differs at least in one or more amino acids from a polypeptide indicated in Table II A or I B, columns 5 or 7, lines 1 to 5 and/or lines 334 to 338. In another embodiment, a nucleic acid molecule indicated in Table I A or I B, columns 5 or 7, lines 1 to 5 and/or lines 334 to 338 does not encode a protein of a sequence indicated in Table II A or II B, columns 5 or 7, lines 1 to 5 and/or lines 334 to 338. Accordingly, in one embodiment, the protein encoded by a sequences of a nucleic acid according to (a) to (l) does not consist of a sequence as indicated in Table II A or II B, columns 5 or 7, lines 1 to 5 and/or lines 334 to 338. In a further embodiment, the protein of the present invention is at least 30%, 40%, 50%, or 60% identical to a protein sequence indicated in Table II A or II B, columns 5 or 7, lines 1 to 5 and/or lines 334 to 338 and less than 100%, preferably less than 99.999%, 99.99% or 99.9%, more preferably less than 99%, 98%, 97%, 96% or 95% identical to a sequence as indicated in Table I A or II B, columns 5 or 7, lines 1 to 5 and/or lines 334 to 338.

The nucleic acid sequences used in the process are advantageously introduced in a nucleic acid construct, preferably an expression cassette which makes possible the expression of the nucleic acid molecules in an organism, advantageously a plant or a microorganism.

Accordingly, the invention also relates to an nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:

(a) introducing of a nucleic acid construct comprising the nucleic acid molecule of the invention or used in the process of the invention or encoding the polypeptide of the present invention or used in the process of the invention; or (b) introducing of a nucleic acid molecule, including regulatory sequences or factors, which expression increases the expression of the nucleic acid molecule of the invention or used in the process of the invention or encoding the polypeptide of the present invention or used in the process of the invention;

in a cell, or an organism or a part thereof, preferably in a plant, plant cell or a microorganism, and (c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned in particular are various binary and cointegrated vector systems which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula, Pichia, Yerrowia, Saccharomyces, Schizosaccharomyces* or *Candida*.

Host organisms which are especially advantageously selected in the process according to the invention are microorganisms selected from the group of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum (=Micrococcus glutamicum), Corynebacterium melassecola, Corynebacterium* sp. or *Escherichia coli*, specifically *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the firet alternative, the constructs, which comprise the codogenic gene segment or the nucleic acid molecule of the invention or the nucleic acid molecule used in the method of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to a sequence indicated in Table I, columns 5 or 7, lines 1 to 5 and/or lines 334 to 338 or its derivatives, it is advantageous additionally to express and/or mutate further genes in the organisms. Especially advantageously, additionally at least one further gene of the amino acid biosynthetic pathway such as for L-lysine, L-threonine and/or L-methionine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine a sequence as indicated in Table I, columns 5 or 7, lines 1 to 5 and/or lines 334 to 338 with genes which generally support or enhances to growth or yield of the target organismen, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the amino acid metabolism, in particular in amino acid synthesis.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine. Furthermore, an advantageous nucleic acid sequence coexpressed can be threonine adlolase and/or lysine decarboxylase as described in the state of the art.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the respective fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60, 70, 80 or 90%, compared with the starting organism, and thus the activity of the enzyme is increased by these figures mentioned compared with the starting organism. An increase in the enzymatic activity means an enzymatic activity which is increased by at least 10%, advantageously at least 20, 30, 40 or 50%, particularly advantageously by at least 60, 70, 80, 90, 100, 200, 300, 500 or 1000%, compared with the starting organism. This leads to an increased productivity of the desired respective fine chemical or of the desired respective fine chemicals.

In a further advantageous embodiment of the process of the invention, the organisms used in the process are those in which simultaneously a methionine degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or the nucleic acid molecule used in the method of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to to the coding sequence of the nucleic acid molecule of the invention or the nucleic acid molecule used in the method of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the Ω enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/ RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a NT-rich sequence which act as quantitative enhancers of gene expression in transgenic tobacco and potato plants (Sandhu et al., 1998; Plant Mol. Biol. 37(5):885-96). Beside that, a large variety of cis-active elements have been described which contribute to specific expression pattern, like organ specific expression or induced expression in response to biotic or abiotic stress. Examples are elements which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, Ipp-lac, lacI$^{q-}$, T7, T5, T3, gal, trc, ara, SP6, $\lambda$-P$_R$ or $\lambda$-P$_L$ promoter, which are advantageously used in Gram-negative bacteria. Further advantageous regulatory sequences are present for example in the Gram-positive promoters amy, dnaK, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4-, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention or the nucleic acid molecule used in the method of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein.

This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination arepolyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell Targeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention a plant can be advantageous. However, inducible expression of the polypeptide of the invention or the polypeptide used in the method of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris, cassava* and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the inventioncomprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the respective fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signalsThese regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992),Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.:583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion $E.\ coli$ expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage which harbors a T7 gn1 gene under the transcriptional control of the lacUV 5 promoter.

Other vectors which are suitable in prokaryotic organisms are known to the skilled worker; these vectors are for example in $E.\ coli$ pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III$^{113}$-B1, λgt11 or pBdCl, in $Streptomyces$ pIJ101, pIJ364, pIJ702 or pIJ361, in $Bacillus$ pUB110, pC194 or pBD214, in $Corynebacterium$ pSA77 or pAJ667.

In a further embodiment, the expression vector is a yeast expression vector. Examples of vectors for expression in the yeasts $S.\ cerevisiae$ encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 μM, pAG-1, YEp6, YEp13 or pEMBLYe23.

Further vectors, which may be mentioned by way of example, are pALS1, pIL2 or pBB116 in fungi or pLGV23, pGHlac$^+$, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell. Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The amino acids produced can be isolated from the organism by methods with which the skilled worker is familiar. For example via extraction, salt precipitation and/or ion-exchange chromatography. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas (Bioreaktoren und periphere Einrichtungen (Vieweg Verlag, Braunschweig/Wiesbaden, 1994)).

In one embodiment, the present invention relates to a polypeptide encoded by the nucleic acid molecule according to the present invention, preferably conferring an increase in the respective fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with an eukaryotic organism as host cell. E.g., in one embodiment the polypeptide is produced in a plant cell or plant with a nucleic acid molecule derived from a prokaryote or a fungus or an alga or an other microorganism but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in E. coli there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, a native polypeptide conferring the increase of the respective fine chemical in an organism or part thereof can be isolated from cells (e.g., endothelial cells), for example using the antibody of the present invention as described below, in particular, an antibody against a protein as indicated in Table II, column 3, lines 1 to 5 and/or lines 334 to 338. E.g. an antibody against a polypeptide as indicated in Table II, columns 5 or 7, lines 1 to 5 and/or lines 334 to 338, or an antigenic part thereof which can be produced by standard techniques utilizing polypeptides comprising or consisting of above mentioned sequences, e.g. the polypeptide of the present invention or fragment thereof. Preferred are monoclonal antibodies specifically binding to polypeptide as indicated in Table II, columns 5 or 7, lines 1 to 5 and/or lines 334 to 338.

In one embodiment, the present invention relates to a polypeptide having the amino acid sequence encoded by a nucleic acid molecule of the invention or the nucleic acid molecule used in the method of the invention or obtainable by a process of the invention. Said polypeptide confers preferably the aforementioned activity, in particular, the polypeptide confers the increase of the respective fine chemical in a cell or an organism or a part thereof after increasing the cellular activity, e.g. by increasing the expression or the specific activity of the polypeptide.

In one embodiment, the present invention relates to a polypeptide having a sequence as indicated in Table II, columns 5 or 7, lines 1 to 5 and/or lines 334 to 338 or as encoded by a nucleic acid molecule as indicated in Table I, columns 5 or 7, lines 1 to 5 and/or lines 334 to 338 or functional homologues thereof.

In one advantageous embodiment, in the method of the present invention the activity of a polypeptide is increased which comprises or consists of a consensus sequence as indicated in Table IV, column 7, lines 1 to 5 and/or lines 334 to 338 and in one another embodiment, the present invention relates to a polypeptide comprising or consisting of a consensus sequence as indicated in Table IV, column 7, lines 1 to 5 and/or lines 334 to 338, whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid or, in an further embodiment, can be replaced and/or absent. In one embodiment, the present invention relates to the method of the present invention comprising a polypeptide or to a polypeptide comprising more than one consensus sequences (of an individual line) as indicated in Table IV, column 7, lines 1 to 5 and/or lines 334 to 338.

In one embodiment not more than 15%, preferably 10%, even more preferred 5%, 4%, 3%, or 2%, most preferred 1% or 0% of the amino acid position indicated by a letter are/is replaced another amino acid or, in an other embodiment, are/is absent and/or replaced. In another embodiment the stretches of non-conserved amino acids, indicated by $(X)_n$ [whereas n indicates the number of X], vary in their length by 20%, preferably by 15 or 10%, even more preferred by 5%, 4%, 3%, 2% or most preferred by only 1%.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence or, in an other embodiment, are absent and/or replaced.

The consensus sequence shown herein was derived from a multiple alignment of the sequences as listed in table II. The consensus sequences of specified domains were derived from a multiple alignment of all sequences. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. YX(21-23)F means that conserved tyrosine and phenylalanine residues are separated from each other by minimum 21 and maximum 23 amino acid residues in all investigated sequences.

The alignment was performed with the Software AlignX (sept 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penality: 10.0; gap extension penality 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 0.9. Presettings were selected to allow also for the alignment of conserved amino acids.

In one advantageous embodiment, the method of the present invention comprises the increasing of a polypeptide comprising or consisting of plant or microorganism specific consensus sequences. Accordingly, in one embodiment, the present invention relates to a polypeptide comprising or consisting of plant or microorganism specific consensus sequences.

In one embodiment, said polypeptide of the invention distinguishes over a sequence as indicated in Table II A or IIB, columns 5 or 7, lines 1 to 5 and/or lines 334 to 338 by one or more amino acids. In one embodiment, polypeptide distinguishes form a sequence as indicated in Table II A or IIB, columns 5 or 7, lines 1 to 5 and/or lines 334 to 338 by more than 1, 2, 3, 4, 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from a sequence as indicated in Table II A or II B, columns 5 or 7, lines 1 to 5 and/or lines 334 to 338 by not more than 80% or 70% of the amino acids, preferably not more than 60% or 50%, more preferred not more than 40% or 30%, even more preferred not more than 20% or 10%. In an other embodiment, said polypeptide of the invention does not consist of a sequence as indicated in Table II A or II B, columns 5 or 7, lines 1 to 5 and/or lines 334 to 338.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to polypeptide conferring an increase in the respective fine chemical in an organism or part being encoded by the nucleic acid molecule of the invention or by a nucleic acid molecule used in the process of the invention.

In one embodiment, the polypeptide of the invention has a sequence which distinguishes from a sequence as indicated in Table II A or II B, columns 5 or 7, lines 1 to 5 and/or lines 334 to 338 by one or more amino acids. In an other embodiment, said polypeptide of the invention does not consist of the sequence as indicated in Table II A or II B, columns 5 or 7, lines 1 to 5 and/or lines 334 to 338. In a further embodiment, said polypeptide of the present invention is less than 100%, 99.999%, 99.99%, 99.9% or 99% identical. In one embodiment, said polypeptide does not consist of the sequence encoded by a nucleic acid molecules as indicated in Table I A or IB, columns 5 or 7, lines 1 to 5 and/or lines 334 to 338.

In one embodiment, the present invention relates to a polypeptide having an activity of a protein as indicated in Table II, column 3, lines 1 to 5 and/or lines 334 to 338, which distinguishes over a sequence as indicated in Table II A or II B, columns 5 or 7, lines 1 to 5 and/or lines 334 to 338 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized.

The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention-chemicals, more preferably less than about 20% chemical precursors or non-polypeptide of the invention-chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

Non-polypeptide of the invention-chemicals are e.g. polypeptides having not the activity and/or amino acid sequence of a polypeptide indicated in Table II, columns 3, 5 or 7, lines 1 to 5 and/or lines 334 to 338.

A polypeptide of the invention can participate in the process of the present invention. The polypeptide or a portion thereof comprises preferably an amino acid sequence which is sufficiently homologous to an amino acid sequence as indicated in Table II, columns 5 or 7, lines 1 to 5 and/or lines 334 to 338 such that the protein or portion thereof maintains the ability to confer the activity of the present invention. The portion of the protein is preferably a biologically active portion as described herein. Preferably, the polypeptide used in the process of the invention has an amino acid sequence identical to a sequence as indicated in Table II, columns 5 or 7, lines 1 to 5 and/or lines 334 to 338.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the nucleotide sequence as indicated in Table I, columns 5 or 7, lines 1 to 5 and/or lines 334 to 338. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence as indicated in Table I, columns 5 or 7, lines 1 to 5 and/or lines 334 to 338 or which is homologous thereto, as defined above.

Accordingly the polypeptide of the present invention can vary from a sequence as indicated in Table II, columns 5 or 7, lines 1 to 5 and/or lines 334 to 338 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of a sequence as indicated in Table II A or IIB, columns 5 or 7, lines 1 to 5 and/or lines 334 to 338.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention or used in the process of the present invention, e.g., an amino acid sequence as indicated in Table II, columns 5 or 7, lines 1 to 5 and/or lines 334 to 338 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention or the nucleic acid molecule used in the method of the invention may result in the production of a protein having essentially the activity of the polypeptides as indicated in Table II, column 3, lines 1 to 5 and/or lines 334 to 338 but having differences in the sequence from said wild-type protein. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention or the polypeptide used in the method of the invention may be utilized to generate plants or parts thereof, expressing one or more wildtype protein(s) or one or more mutated protein encoding nucleic acid molecule(s) or polypeptide molecule(s) of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition comprising the respective fine chemical or a recovered respective fine chemical, in particular, the fine chemical, free or in protein-bound form.

Preferably, the compound is a composition comprising the methionine or a recovered methionine, in particular, the fine chemical, free or in protein-bound form.

The invention also provides chimeric or fusion proteins. As used herein, an "chimeric protein" or "fusion protein" comprises an polypeptide operatively linked to a polypeptide which does not confer above-mentioned activity, in particular, which does not confer an increase of content of the respective fine chemical in a cell or an organism or a part thereof, if its activity is increased.

In one embodiment, an reference to a "protein (=polypeptide) of the invention" or as indicated in Table II, columns 5 or 7, lines 1 to 5 and/or lines 334 to 338 refers to a polypeptide having an amino acid sequence corresponding to the polypeptide of the invention or used in the process of the invention, whereas a "non-polypeptide of the invention" or "other polypeptide" not being indicated in Table II, columns 5 or 7, lines 1 to 5 and/or lines 334 to 338 refers to a polypeptide having an amino acid sequence corresponding to a protein which is not substantially homologous a polypeptide of the invention, preferably which is not substantially homologous to a polypeptide as indicated in Table II, columns 5 or 7, lines 1 to 5 and/or lines 334 to 338, e.g., a protein which does not confer the activity described herein or annotated or known for as indicated in Table II, column 3, lines 1 to 5 and/or lines 334 to 338, and which is derived from the same or a different organism. In one embodiment, a "non-polypeptide of the invention" or "other polypeptide" not being indicated in Table II, columns 5 or 7, lines 1 to 5 and/or lines 334 to 338 does not confer an increase of the respective fine chemical in an organism or part thereof.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a polypeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention or the nucleic acid molecule used in the method of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modelling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention or the polypeptide used in the method of the invention and its substrates or binding factors can be used for the identification or design of mutants with modulated binding or turn over activities. For example, the active centre of the polypeptide of the present invention can be modelled and amino acid residues participating in the catalytic reaction can be modulated to increase or decrease the binding of the substrate to activate or improve the polypeptide. The identification of the active centre and the amino acids involved in the catalytic reaction facilitates the screening for mutants having an increased activity.

The sequences shown in column 5 of the Tables Ito IV herein have also been described under their Gene/ORF Locus Name as described in the Table I, II, III or IV, column 3.

In an especially preferred embodiment, the polypeptide according to the invention furthermore also does not have the sequences of those proteins which are encoded by the sequences shown in the known listed Gene/ORF Locus Names or as described in the Tables, column 3.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof. The "anti-sense strand" contains an inverted sequence, which is complementary to that of the "sense strand".

In addition the expression levels and/or the activity can be modified by the introduction of mutations in the regulatory or coding regions of the nucleic acids of the invention. Furthermore antibodies can be expressed which specifically binds to a polypeptide of interest and thereby blocks it activity. The protein-binding factors can, for example, also be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention or the nucleic acid molecule used in the method of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5"-UTR or 3"-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule to the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention or the nucleic acid molecule used in the method of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methyl-inosine, 2,2-dimethylguanine, 2-methyladenine, 2-methylguanine, 3-methylcytosine, 5-methylcytosine, N6-adenine, 7-methylguanine, 5-methylaminomethyluracil, 5-meth-oxyaminomethyl-2-thiouracil, beta-D-mannosylqueosine, 5'-methoxycarboxymethyl-uracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy-acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention or the polypeptide used in the method of the invention having aforementioned the respective fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention or the nucleic acid molecule used in the method of the invention can be an α-anomeric nucleic acid molecule. An α-anomeric nucleic acid molecule forms specific double-stranded hybrids with complementary RNA in which, contrary to the usual units, the strands run parallel to each other (Gaultier et al. (1987) *Nucleic Acids. Res.* 15:6625-6641). The antisense nucleic acid molecule can also comprise a 2'-o-methyl-ribonucleotide (Inoue et al. (1987) *Nucleic Acids Res.* 15:6131-6148) or a chimeric RNA-DNA analogue (Inoue et al. (1987) *FEBS Lett.* 215:327-330).

Further the antisense nucleic acid molecule of the invention or the nucleic acid molecule used in the method of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts encoding the polypeptide of the invention or the polypeptide used in the method of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or the nucleic acid molecule used in the method of the invention or coding a protein used in the process of the invention or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J. W. (1993) *Science* 261:1411-1418.

The antisense molecule of the present invention comprises also a nucleic acid molecule comprising a nucleotide sequences complementary to the regulatory region of an nucleotide sequence encoding the natural occurring polypeptide of the invention or the polypeptide used in the method of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6): 569-84; Helene, C. et al. (1992) *Ann. N.Y. Acad. Sci.* 660:27-36; and Maher, L. J. (1992) *Bioassays* 14(12): 807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as *Neurospora*, zebrafish, *Drosophila*, mice, planaria, humans, *Trypanosoma, petunia* or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of a nucleic acid sequences as indicated in Table I, columns 5 or 7, lines 1 to 5 and/or lines 334 to 338 and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived there from), bring about altered metabolic activity by the reduction in the expression of a nucleic acid sequences as indicated in Table I, columns 5 or 7, lines 1 to 5 and/or lines 334 to 338 and/or homologs thereof. In a double-stranded RNA molecule for reducing the expression of an protein encoded by a nucleic acid sequence of one of the sequences as indicated in Table I, columns 5 or 7, lines 1 to 5 and/or lines 334 to 338 and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in non-mammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence as indicated in Table I, columns 5 or 7, lines 1 to 5 and/or lines 334 to 338 or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence as indicated in Table I, columns 5 or 7, lines 1 to 5 and/or lines 334 to 338 or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extra-cellularly (for example into the interstitial space).

Advantageously the RNAi method leads to only a partial loss of gene function and therefore enables the skilled worker to study a gene dose effect in the desired organism and to fine tune the process of the invention. Furthermore it enables a person skilled in the art to study multiple functions of a gene.

Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the respective fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with *Agrobacteria*, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

*Agrobacteria* transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet. 208:274-289; Feldmann K (1992). In: C Koncz, N-H Chua and J Shell, eds, Methods in *Arabidopsis Research. Word Scientific, Singapore, pp.* 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the"floral dip" method the developing floral tissue is incubated briefly with a surfactant-treated agrobacterial suspension (Clough, S J and Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol. Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22 (2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the respective fine chemical in a cell or an organism or a part thereof, e.g. the nucleic acid molecule of the invention or the nucleic acid molecule used in the method of the invention, the nucleic acid construct of the invention, the antisense molecule of the invention, the vector of the invention or a nucleic acid molecule encoding the polypeptide of the invention or the polypeptide used in the method of the invention, e.g. the polypeptide as indicated in Table II, columns 5 or 7, lines 1 to 5 and/or lines 334 to 338. Due to the above mentioned activity the respective fine chemical content in a cell or an organism is increased. For example, due to modulation or manipulation, the cellular activity of the polypeptide of the invention or the polypeptide used in the method of the invention or the nucleic acid molecule of the invention or the nucleic acid molecule used in the method of the invention is increased, e.g. due to an increased expression or specific activity of the subject matters of the invention in a cell or an organism or a part thereof. In one embodiment, transgenic for a polypeptide having an activity of a polypeptide as indicated in Table II, columns 5 or 7, lines 1 to 5 and/or lines 334 to 338 means herein that due to modulation or manipulation of the genome, an activity as annotated for a polypeptide as indicated in Table II, column 3, lines 1 to 5 and/or lines 334 to 338, e.g. having a sequence as indicated in Table II, columns 5 or 7, lines 1 to 5 and/or lines 334 to 338, is increased in a cell or an organism or a part thereof. Examples are described above in context with the process of the invention "Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either
a) the nucleic acid sequence, or
b) a genetic control sequence linked operably to the nucleic acid sequence, for example a promoter, or
c) (a) and (b)
are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of a promoter of a polypeptide of the invention with the corresponding protein-encoding sequence—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the respective fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the respective fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the above-mentioned plant genus, more preferred from abovementioned plants species.

Transgenic plants comprising the amino acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The amino acids produced in the process according to the invention may, however, also be isolated from the plant in the form of their free amino acids or bound in proteins. Amino acids produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention or the nucleic acid molecule used in the method of the invention.

In another embodiment, the present invention relates also to a transgenic microorganism comprising the nucleic acid molecule of the invention or the nucleic acid molecule used in the method of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced amino acid composition or the produced respective fine chemical is isolated.

In this manner, more than 50% by weight, advantageously more than 60% by weight, preferably more than 70% by weight, especially preferably more than 80% by weight, very especially preferably more than 90% by weight, of the fine chemicals produced in the process can be isolated. The resulting fine chemicals can, if appropriate, subsequently be further purified, if desired mixed with other active ingredients such as vitamins, amino acids, carbohydrates, antibiotics and the like, and, if appropriate, formulated.

In one embodiment, the fatty acid is the fine chemical.

The amino acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the amino acid composition produced or the fine chemical produced if desired and formulating the product with a pharmaceutical acceptable carrier or formulating the product in a form acceptable for an application in agriculture. A further embodiment according to the invention is the use of the amino acids produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus, Corynebacterium, Micrococcus, Brevibacterium, Rhodococcus, Nocardia, Caseobacter* or *Arthrobacter* or Gram-negative bacteria such as the genera *Escherichia, Flavobacterium* or *Salmonella* or yeasts such as the genera *Rhodotorula, Hansenula* or *Candida*. Particularly advantageous organisms are selected from the group of genera *Corynebacterium, Brevibacterium, Escherichia, Bacillus, Rhodotorula, Hansenula, Candida, Claviceps* or *Flavobacterium*. It is very particularly advantageous to use in the process of the invention microorganisms selected from the group of genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing sulfur-containing fine chemicals, in particular the respective fine chemical, e.g. amino acids containing sulfur it is possible to use as sulfur source inorganic sulfur-containing compounds such as, for example, sulfates, sulfites, dithionites, tetrathionates, thiosulfates, sulfides or else organic sulfur compounds such as mercaptans and thiols.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P. M. Rhodes, P. F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular L-methionine, L-threonine and/or L-lysine, normally have a dry matter content of from 7.5 to 25% by weight. Sugar-limited fermentation is additionally advantageous, at least at the end, but especially over at least 30% of the fermentation time. This means that the concentration of utilizable sugar in the fermentation medium is kept at, or reduced to, 0 to 3 g/l during this time. The fermentation broth is then processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the amino acid produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavourings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the respective fine chemical production in a cell, comprising the following steps:
  (a) contacting, e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;
  (b) identifying the nucleic acid molecules, which hybridize under relaxed stringent conditions with the nucleic acid molecule of the present invention in particular to a nucleic acid molecule sequence as indicated in Table I, columns 5 or 7, lines 1 to 5 and/or lines 334 to 338, preferably in Table I B, columns 5 or 7, lines 1 to 5 and/or lines 334 to 338 and, optionally, isolating the full length cDNA clone or complete genomic clone;
  (c) introducing the candidate nucleic acid molecules in host cells, preferably in a plant cell or a microorganism, appropriate for producing the respective fine chemical;
  (d) expressing the identified nucleic acid molecules in the host cells;
  (e) assaying the respective fine chemical level in the host cells; and
  (f) identifying the nucleic acid molecule and its gene product which expression confers an increase in the respective fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In an other embodiment, the present invention relates to a method for the identification of a gene product conferring an increase in the respective fine chemical production in a cell, comprising the following steps:
  (a) identifying nucleic acid molecules of an organism; which can contain a candidate gene encoding a gene product conferring an increase in the respective fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
(b) introducing the candidate nucleic acid molecules in host cells, preferably in a plant cells or microorganisms, appropriate for producing the respective fine chemical;
(c) expressing the identified nucleic acid molecules in the host cells;
(d) assaying the respective fine chemical level in the host cells; and
(e) identifying the nucleic acid molecule and its gene product which expression confers an increase in the respective fine chemical level in the host cell after expression compared to the wild type.

Eventually gene products conferring the increase in the respective fine chemical production can also be identify according to a identical or similar 3D structure in step (a) and by the above described method.

The nucleic acid molecules identified can then be used for the production of the respective fine chemical in the same way as the nucleic acid molecule of the present invention. Accordingly, in one embodiment, the present invention relates to a process for the production of the respective fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the respective fine chemical to said plant comprising:
a) contacting cells which express the polypeptide of the present invention or its mRNA with a candidate compound under cell cultivation conditions;
b) assaying an increase in expression of said polypeptide or said mRNA;
c) comparing the expression level to a standard response made in the absence of said candidate compound; whereby, an increased expression over the standard indicates that the compound is stimulating production of the respective fine chemical.

Furthermore, in one embodiment, the present invention relates to a method for the screening for agonists or an antagonist of the activity of the polypeptide of the present invention or used in the process of the present invention, e.g. a polypeptide conferring an increase of the respective fine chemical in an organism or a part thereof after increasing the activity in an organism or a part thereof, comprising:
(a) contacting cells, tissues, plants or microorganisms which express the polypeptide according to the invention with a candidate compound or a sample comprising a plurality of compounds under conditions which permit the expression the polypeptide of the present invention or used in the process of the present invention;
(b) assaying the respective fine chemical level or the polypeptide expression level in the cell, tissue, plant or microorganism or the media the cell, tissue, plant or microorganisms is cultured or maintained in; and
(c) identifying a agonist or antagonist by comparing the measured the respective fine chemical level or polypeptide of the invention or used in the invention expression level with a standard respective fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to process for the identification of a compound conferring increased the respective fine chemical production in a plant or microorganism, comprising the steps:
(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and
(b) identifying if the compound is an effective agonist by detecting the presence or absence or increase of a signal produced by said readout system.

The screen for a gene product or an agonist conferring an increase in the respective fine chemical production can be performed by growth of an organism for example a microorganism in the presence of growth reducing amounts of an inhibitor of the synthesis of the respective fine chemical. Better growth, e.g. higher dividing rate or high dry mass in comparison to the control under such conditions would identify a gene or gene product or an agonist conferring an increase in fine chemical production.

One can think to screen for increased production of the respective fine chemical by for example searching for a resistance to a drug blocking the synthesis of the respective fine chemical and looking whether this effect is dependent on the activity or expression of a polypeptide as indicated in Table II, columns 5 or 7, lines 1 to 5 and/or lines 334 to 338 or a homolog thereof, e.g. comparing the phenotype of nearly identical organisms with low and high activity of a protein as indicated in Table II, columns 5 or 7, lines 1 to 5 and/or lines 334 to 338 after incubation with the drug.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the respective fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the respective fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell.

Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the arm, e.g. buffers and solutions for hydridization assays, e.g. the aforementioned solutions and buffers, further and means for Southern-, Western-, Northern—etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the respective fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or the polypeptide used in the method of the invention or comprising the steps of the method according to the invention for the identification of said compound, agonist or antagonist; and formulating the nucleic acid molecule, the vector or the polypeptide of the invention or the polypeptide used in the method of the invention or the agonist, or compound identified according to the methods or processes of the present invention or with use of the subject matters of the present invention in a form applicable as plant agricultural composition.

In another embodiment, the present invention relates to a method for the production of a "the respective fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the respective fine chemical production as mentioned and related organisms; mapping of genomes; identification and localization of sequences of interest; evolutionary studies; determination of regions required for function; modulation of an activity.

The nucleic acid molecule of the invention or the nucleic acid molecule used in the method of the invention, the vector of the invention or the nucleic acid construct of the invention may also be useful for the production of organisms resistant to inhibitors of the amino acid production biosynthesis pathways. In particular, the overexpression of the polypeptide of the present invention may protect plants against herbicides, which block the amino acid, in particular the respective fine chemical, synthesis in said plant. Inhibitors may inhibit one or more of the steps for the synthesis of methionine. The first committed step for the synthesis of Lys, Met and Thr is the first step, in which aspartate is phosphorylated to aspartyl-b-phosphate, catalyzed by aspartokinase: E. coli has 3 isozymes of aspartokinase that respond differently to each of the 3 amino acids, with regard to enzyme inhibition and feedback inhibition. The biosynthesis of lysine, methionine and threonine are not, then, controlled as a group. The pathway from aspartate to lysine has 10 steps. The pathway from aspartate to threonine has 5 steps. The pathway from aspartate to methionine has 7 steps. Regulation of the three pathways also occurs at the two branch points:

b-Aspartate-semialdehyde (homoserine and lysine)
Homoserine (threonine and methionine)

The regulation results from feedback inhibition by the amino acid products of the branches, indicated in the brackets above. One important step in the synthesis of this group of 3 amino acids is the step in which homocysteine is converted to methionine, catalyzed by the enzyme methionine synthase:

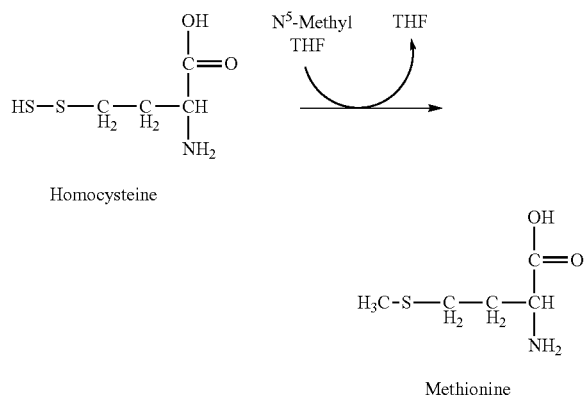

In this reaction, homocysteine is methylated to methionine, and the C1 donor is N5-methyl-THF. Thus, inhibition of one or more of the methionine synthesis enzymes, including also the provision of donor molecules, can inhibit the synthesis of methionine.

Examples of herbicides blocking the amino acid synthesis in plants are for example sulfonylurea and imidazolinone herbicides, which catalyze the first step in branched-chain amino acid biosynthesis. Inhibitors of the methionine synthesis may for example described in Danishpajooh 10, 2001 Nitric oxide inhibits methionine synthase activity in vivo and disrupts carbon flow through the folate pathway. J. Biol. Chem. 276: 27296-27303; Datko AH, 1982 Methionine biosynthesis in Lemna—inhibitor studies. Plant Physiol. 69: 1070-1076; Lavrador K, 1998 A new series of cyclic amino acids as inhibitors of S-adenosyl L-methionine synthetase. Bioorg. Med. Chem. Lett. 8: 1629-1634; Thompson G A, 1982 Methionine synthesis in Lemna—inhibition of cystathionine gamma-synthase by propargylglycine. Plant Physiol. 70: 1347-1352. In some organisms the methionine synthesis is inhibited by ethanol, lead, mercury, aluminium, thimerosal, cupper, N2O, as e.g. discussed in M. Waly, H. Oleteanu et al., 2004, Molecular Psychiatry, 1-13.

Interestingly, *Arabidopsis* seed germination was strongly delayed in the presence of DL-propargylglycine, a specific inhibitor of methionine synthesis. Furthermore, this compound totally inhibited seedling growth. These phenotypic effects were largely alleviated upon methionine supplementation in the germination medium. The results indicated that methionine synthase and S-adenosylmethionine synthetase are fundamental components controlling metabolism in the transition from a quiescent to a highly active state during seed germination. Moreover, the observed temporal patterns of accumulation of these proteins are consistent with an essential role of endogenous ethylene in *Arabidopsis* only after radicle protrusion; s. Gallarado, K., 2002, Importance of methionine biosynthesis for *Arabidopsis* seed germination and seedling growth, Physiolgia Plantarum, 116(2), pp 238-247. Accordingly, the overexpression of a polypeptide of the present invention in a plant may protect the plant against a herbicide inhibiting methionine synthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention or the nucleic acid molecule used in the method of the invention may be sufficiently homologous to the sequences of related species such that these nucleic acid molecules may serve as markers for the construction of a genomic map in related organism.

Accordingly, the present invention relates to a method for breeding plants for the production of the respective fine chemical, comprising
  (a) providing a first plant variety produced according to the process of the invention preferably (over)expressing the nucleic acid molecule of the invention or the nucleic acid molecule used in the method of the invention;
  (b) crossing the first plant variety with a second plant variety; and
  (c) selecting the offspring plants which overproduce the respective fine chemical by means of analysis the distribution of a molecular marker in the offspring representing the first plant variety and its capability to (over) produce the respective fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention or the nucleic acid molecule used in the method of the invention and/or its expression level. Accordingly, the molecular marker can be a probe or a PCR primer set useful for identification of the genomic existence or genomic localisation of the nucleic acid molecule of the invention or the nucleic acid molecule used in the method of the invention, e.g. in a Southern blot analysis or a PCR or its expression level, i.g. in a Northern Blot analysis or a quantitative PCR.

Accordingly, in one embodiment, the present invention relates to the use of the nucleic acid molecule of the present invention or encoding the polypeptide of the present invention as molecular marker for breeding, especially for breeding for a high or low respective fine chemical production.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention or the nucleic acid molecule used in the method of the invention can be used for the identification of other nucleic acids conferring an increase of the respective fine chemical after expression.

Further, the nucleic acid molecule of the invention or the nucleic acid molecule used in the method of the invention or a fragment of a gene conferring the expression of the polypeptide of the invention or the polypeptide used in the method of the invention, preferably comprising the nucleic acid molecule of the invention, can be used for marker assisted breeding or association mapping of the respective fine chemical derived traits Accordingly, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical or of the fine chemical and one or more other amino acids, in particular Threoinine, Alanine, Glutamin, Glutamic acid, Valine, Asparagine, Phenylalanine, Leucine, Proline, Tryptophan Tyrosine, Valine, Isoleucine and Arginine.

Accordingly, the nucleic acid of the invention, or the nucleic acid molecule identified with the method of the present invention or the complement sequences thereof, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the respective fine chemical in a organism or part thereof, e.g. in a cell.

Further, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist or the agonist identified with the method of the invention, the antibody of the present invention, the antisense molecule of the present invention or the nucleic acid molecule identified with the method of the present invention, can be used for the preparation of an agricultural composition.

Furthermore, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, antagonist or the agonist identified with the method of the invention, the antibody of the present invention, the antisense molecule of the present invention or the nucleic acid molecule identified with the method of the present invention, can be used for the identification and production of compounds capable of conferring a modulation of the respective fine chemical levels in an organism or parts thereof, preferably to identify and produce compounds conferring an increase of the respective fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nlm.nih.gov/PubMed/medline.html. Further databases and addresses, such as hftp://www.ncbi.nlm.nih.gov/, hftp://www.infobiogen.fr/, hftp://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.

1) Increase of the metabolites:
   Max: maximal x-fold (normalised to wild type)-
   Min: minimal x-fold (normalised to wild type)
2) Decrease of the metabolites:
   Max: maximal x-fold (normalised to wild type)  (minimal decrease)
   Min: minimal x-fold (normalised to wild type)  (maximal decrease)

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning into in *Escherichia coli*

A DNA polynucleotide with a sequence as indicated in Table I, column 5 and encoding a polypeptide as listed in Table 1 below, was cloned into the plasmids pBR322 (Sutcliffe, J. G. (1979) Proc. Natl. Acad. Sci. USA, 75: 3737-3741); pACYC177 (Change & Cohen (1978) J. Bacteriol. 134: 1141-1156); plasmids of the pBS series (pBSSK+, pBSSK– and others; Stratagene, LaJolla, USA) or cosmids such as SuperCosi (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of *Haemophilus Influenzae* Rd., Science 269; 496-512)".

Example 3

In-Vivo and In-Vitro Mutagenesis

An in vivo mutagenesis of *Corynebacterium glutamicum* for the production of the respective fine chemical can be carried out by passing a plasmid DNA (or another vector DNA) through *E. coli* and other microorganisms (for example *Bacillus* spp. or yeasts such as *Saccharomyces cerevisiae*), which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. Dpnl site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired respective fine chemical.

Example 4

DNA Transfer Between *Escherichia coli* and *Corynebacterium glutamicum*

Several *Corynebacterium* and *Brevibacterium* species comprise endogenous plasmids (such as, for example, pHM1519 or pBL1) which replicate autonomously (for a review, see, for example, Martin, J. F. et al. (1987) Biotechnology 5: 137-146). Shuttle vectors for *Escherichia coli* and *Corynebacterium glutamicum* can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), which have a replication origin for, and suitable marker from, *Corynebacterium glutamicum* added. Such replication origins are preferably taken from endogenous plasmids, which have been isolated from *Corynebacterium* and *Brevibacterium* species. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim). There are many examples in the literature of the preparation of a large multiplicity of shuttle vectors which are replicated in *E. coli* and *C. glutamicum* and which can be used for various purposes including the overexpression of genes (see, for example, Yoshihama, M. et al. (1985) J. Bacteriol. 162: 591-597, Martin, J. F. et al., (1987) Biotechnology, 5: 137-146 and Eikmanns, B. J. et al. (1992) Gene 102: 93-98). Suitable vectors, which replicate in coryneform bacteria are, for example, pZ1 (Menke) et al., Appl. Environ. Microbiol., 64, 1989: 549-554) pEkEx1 (Eikmanns et al., Gene 102, 1991: 93-98) or pHS2-1 (Sonnen et al, Gene 107, 1991: 69-74). These vectors are based on the cryptic plasmids pHM1519, pBL1 or pGA1. Other plasmid vectors such as, for example, those based on pCG4 (U.S. Pat. No. 4,489,160), pNG2 (Serwold-Davis et al., FEMS Microbiol. Lett., 66, 1990: 119-124) or pAG1 (U.S. Pat. No. 5,158,891) can be used in the same manner.

Using standard methods, it is possible to clone a gene of interest into one of the above-described shuttle vectors and to introduce such hybrid vectors into *Corynebacterium glutamicum* strains. The transformation of *C. glutamicum* can be achieved by protoplast transformation (Kastsumata, R. et al., (1984) J. Bacteriol. 159, 306-311), electroporation (Liebl, E. et al., (1989) FEMS Microbiol. Letters, 53: 399-303) and in those cases where specific vectors are used also by conjugation (such as, for example, described in Schäfer, A., et al. (1990) J. Bacteriol. 172: 1663-1666). Likewise, it is possible to transfer the shuttle vectors for *C. glutamicum* to *E. coli* by preparing plasmid DNA from *C. glutamicum* (using standard methods known in the art) and transforming it into *E. coli*. This transformation step can be carried out using standard methods, but preferably using an Mcr-deficient *E. coli* strain, such as NM522 (Gough & Murray (1983) J. Mol. Biol. 166: 1-19).

If the transformed sequence(s) is/are to be integrated advantageously into the genome of the coryneform bacteria, standard techniques known to the skilled worker also exist for this purpose. Examples, which are used for this purpose are plasmid vectors as they have been described by Remscheid et al. (Appl. Environ. Microbiol., 60, 1994: 126-132) for the duplication and amplification of the hom-thrB operon. In this method, the complete gene is cloned into a plasmid vector which is capable of replication in a host such as *E. coli*, but not in *C. glutamicum*. Suitable vectors are, for example, pSUP301 (Simon et al., Bio/Technology 1, 1983: 784-791), pKIBmob or pK19mob (Schäfer et al., Gene 145, 1994: 69-73), pGEM-T (Promega Corp., Madison, Wis., USA), pCR2.1-TOPO (Schuman, J. Biol. Chem., 269, 1994: 32678-32684, U.S. Pat. No. 5,487,993), pCR®Blunt (Invitrogen, Groningen, the Netherlands) or pEM1 (Schrumpf et al., J. Bacteriol., 173, 1991: 4510-4516).

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* or other microorganisms by a variety of methods, which are known in the art, e.g. as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicates the presence and the amount of the sought mutant protein in the cell. However, other methods are also known.

Example 6

Growth of Genetically Modified *Corynebacterium glutamicum*: Media and Culture Conditions Genetically modified *Corynebacteria* are grown in synthetic or natural growth media. A number of different growth media for *Corynebacteria* are known and widely available (Lieb et al. (1989) Appl. Microbiol. Biotechnol. 32: 205-210; von der Osten et al. (1998) Biotechnology Letters 11: 11-16; Patent DE 4 120 867; Liebl (1992) "The Genus *Corynebacterium*", in: The Procaryotes, Vol. II, Balows, A., et al., Ed. Springer-Verlag).

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as $NH_4Cl$, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar and 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or NH$_4$OH. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by introducing of a preculture of seed organisms.

For example, the media are inoculated by introducing of a saline solution of *C. glutamicum* cells from CM plates or by addition of a liquid preculture of this bacterium.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 8

Analysis of the Effect of the Nucleic Acid Molecule on the Production of the Amino Acids The effect of the genetic modification in *C. glutamicum* on the production of an amino acid can be determined by growing the modified microorganisms under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 9

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 1 for the Expression in Plants

Unless otherwise specified, standard methods as described in Sambrook et al., Molecular Cloning: A laboratory manual, Cold Spring Harbor 1989, Cold Spring Harbor Laboratory Press are used.

SEQ ID NO: 1 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Pfu Turbo DNA polymerase. The amplification cycles were as follows:
1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C. The composition for the protocol of the Herculase polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Herculase polymerase. The amplification cycles were as follows:
1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID NO: 1:
i) forward primer (SEQ ID NO: 3)
ATGGAACAGAACAGGTTCAAGAAAG
ii) reverse primer (SEQ ID NO: 4)
TTACAGTTTTTGTTTAGTCGTTTTAAC Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector. The PCR-products, produced by Pfu Turbo DNA polymerase, were phosphorylated using a T4 DNA polymerase using a standard protocol (e.g. MBI Fermentas) and cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well. The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID NO: 1

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000) "A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The *agrobacteria* generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1 000 seeds per dish. The dishes were covered with a hood and placed in the stratification facility (8 h, 110 $\mu mol/m^2/s^{-1}$, 22° C.; 16 h, dark, 6° C.). After 5 days, the dishes were placed into the short-day controlled environment chamber (8 h 130 $\mu mol/m^2/s^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 $\mu$E, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 $\mu$l Silwett L77 (Crompton S. A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s-1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 μl of N-methyl-N-(trimethylsilyl)-2,2,2-trifluoroacetamide (MSTFA) was carried out for 30 minutes at 60° C., again in the tightly sealed vessel. The final volume before injection into the GC was 110 μl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the described changes in comparison with wild-types were caused by the introduced genes.

As an alternative, the amino acids can be detected advantageously via HPLC separation in ethanolic extract as described by Geigenberger et al. (Plant Cell & Environ, 19, 1996: 43-55).

The results of the different plant analyses can be seen from the table 1 which follows:

| ORF | ANNOTATION | Metabolite | Min | Max | Method |
| --- | --- | --- | --- | --- | --- |
| YBL015W | acetyl-CoA hydrolase | Methionine | 1.42 | 2.16 | LC |
| YER173W | checkpoint protein, | Methionine | 1.35 | 1.60 | GC |
| YLR375W | involved in pre-tRNA splicing and in uptake of branched-chain amino acids | Methionine | 1.27 | 2.93 | LC + GC |
| YOR084W | putative peroxisomal lipase | Methionine | 3.18 | 3.18 | GC |
| b1829 | heat shock protein with protease activity | Methionine | 1.29 | 3.73 | GC |
| b4232 | fructose-1,6-bisphosphatase | Methionine | 1.20 | 1.21 | LC |
| b0464 | transcriptional repressor for multidrug efflux pump (TetR/AcrR family) | Methionine | 1.35 | 4.66 | GC |
| b1343 | ATP-dependent RNA helicase, stimulated by 23S rRNA | Methionine | 1.38 | 1.51 | GC |
| b2414 | subunit of cysteine synthase A and O-acetylserine sulfhydrolase A, PLP-dependent enzyme | Methionine | 1.37 | 1.75 | LC |
| b2762 | 3'-phosphoadenosine 5'-phosphosulfate (PAPS) reductase | Methionine | 1.43 | 1.69 | LC + GC |

Column 3 shows the metabolite/respective fine chemical analyzed. Columns 4 and 5 shows the ratio of the analyzed metabolite/respective fine chemical between the transgenic plants and the wild type; Increase of the metabolites: Max: maximal x-fold (normalised to wild type)-Min: minimal x-fold (normalised to wild type). Decrease of the metabolites: Max: maximal x-fold (normalised to wild type) (minimal decrease), Min: minimal x-fold (normalised to wild type) (maximal decrease). Column 6 indicates the analytical method.

When the analyses were repeated independently, all results proved to be significant.

Example 14a

Engineering Ryegrass Plants by Over-Expressing the Polynucleotide Characterized in the Invention, e.g. Derived from *Saccharomyces cerevisiae*, *E. Coli* or Plants or an Other Organism Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 μm in size) are coated with plasmid DNA according to method of Sanford et al., 1993 and are delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14b

Engineering Soybean Plants by Over-Expressing the Polynucleotide Characterized in the Invention, e.g. Derived from *Saccharomyces cerevisiae, E. coli* or Plants or Another Organism Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 μE-m-2 s-1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1 agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing the Polynucleotide Characterized in the Invention, e.g. Derived from *Saccharomyces cerevisiae, E. Coli* or Plants or Another Organism Amplification of for example SEQ ID NO: 1 was achieved as described in example 10 except that the upstream primer SEQ ID NO:3 and the reverse primer SEQ ID NO: 4 contained the following 5"extensions:
  i) forward primer: 5"-GGGTCGCTCCTACGCG-3" SEQ ID NO: 68243
  ii) reverse primer 5"-CTCGGGCTCGGCGTCC-3" SEQ ID NO: 68246
Vector Construction The maize transformation vector for constitutive expression was constructed as follows.

As base vectors, the vectors EG073qcz (SEQ ID NO 68240) and EG065qcz (SEQ ID NO: 68241) were chosen. The MCS from EG065qcz was deleted by digestion of the vector with Asp718 and PstI, followed by blunting of the vector using T4 DNA polymerase. The blunted vector was religated. The vector generated was called EG065-MCS. The LIC cassette was cloned in the vector EG065-MCS by hybridizing the following oligos, generating a DNA fragment with ends able to ligate into a SmaI and SacI digested vector. This fragment was ligated into the vector EG065-MCS that had been digested with SmaI and SacI. The generated vector was called EG065-LIC. The complete expression cassette comprising ScBV (Schenk (1999) Plant Mol Biol 39(6):1221-1230) promoter, LIC cassette and terminator was cut out of EG065-LIC with AscI and PacI and ligated into the vector EG073qcz that had previously been digested with AscI and PacI. The resulting binary vector for corn transformation was called pMME0607 (SEQ ID NO: 68242).
Oligo POCCLicMluISacIIfw: gggtcgctcctacgcgtcaatgatccgcggacgccgagcccgagct (SEQ ID NO: 68244)
Oligo POCCLicMluISacIrev: cgggctcggcgtccgcggatcattgacgcgtaggagcgaccc (SEQ ID NO: 68245)

For cloning of a polynucleotide of the invention, for example the ORF of SEQ ID NO: 1, from *S. cerevisiae* the vector DNA was treated with the restriction enzyme MluI and SacII. The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 14c.a

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of *agrobacterium* for around 30 minutes. Excised embryos were removed from liquid and then co-cultivated in the dark at 22° C. with *Agrobacterium tumefaciens* on solid MS-based callus induction medium containing 2 mg/l 2,4-D, 10 um AgNO3, and 200 um Acetosyringone. After several days of co-cultivation, embryos were transferred to MS-based media containing 2 mg/l 2,4, 10 um AgNO3 and 200 mg/l Timentin in the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 uE/m2/s−1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s−1. After plants were grown to 4-6 leaf stage they were moved to 14 inch pots containing Metro-Mix® 360. Supplemental metal-halide lamps were used to maintain >800uE/m2/s−1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

Example 14c.b

Growth of T0 Corn Plants for Metabolic Analysis

Plants were grown under the following standardized conditions to properly stage them for T0 sampling. T0 plantlets were transferred to 14" pots in the greenhouse after they grow to 4-6 leaf stage (1-3 weeks). pBSMM232 containing plants were produced carried along with each experiment to serve as controls for T0 samples. Plantlets were moved to 14" pots on Tuesday of each week. Plants were grown for 9 days until the 7-13 leaf stage is reached. On Thursday between 10 am and 2 pm leaf sampling was performed on the 3rd youngest ($1^{st}$ fully elongated). Within 30 seconds 250-500 mg of leaf material (without midrib), were removed weighed and placed into pre-extracted glass thimbles in liquid nitrogen. A second sample (opposite side of the midrib) from each plant was sampled as described above for qPCR analysis.

Example 14c.c

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 7 days old, they were subjected to select transgenic plants. For this purposes pieces of plant leaves were sampled and a PCR reaction with the respective primers for the transgene were performed. Plants exhibiting the transgene were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Example 14c.d

Metabolic Analysis of Maize Leaves

The modifications identified in accordance with the invention, in the content of above-described metabolites, were identified by the following procedure.

a) Sampling and Storage of the Samples

Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen. The time elapsing between cutting the leave to freezing it in liquid nitrogen amounted to not more than 30 seconds. The boxes were stored in a freezer at −80° C., an shipped on dry ice.

b) Lyophilization

During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-decanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 μl of chloroform, 37 μl of hydrochloric acid (37% by weight HCl in water), 320 μl of methanol and 20 μl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 μl for 1.5 hours at 60° C.) in a tightly sealed vessel. 20 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 μl of N-methyl-N-(trimethylsilyl)-2,2,2-trifluoroacetamide (MSTFA) was carried out for 30 minutes at 60° C., again in the tightly sealed vessel. The final volume before injection into the GC was 220 μl.

f) Derivatization of the Polar Phase for the GC/MS Analysis

The methoximation of the carbonyl groups was carried out by reaction with methoxyamine hydrochloride (20 mg/ml in pyridine, 50 μl for 1.5 hours at 60° C.) in a tightly sealed vessel. 10 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 μl of N-methyl-N-(trimethylsilyl)-2,2,2-trifluoroacetamide (MSTFA) was carried out for 30 minutes at 60° C., again in the tightly sealed vessel. The final volume before injection into the GC was 110 μl.

g) Analysis of the Various Plant Samples

The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Transformation of maize (*Zea Mays* L.) can also be performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673 can be used to provide constitutive expression of the trait gene.

Excised embryos can be grown on callus induction medium, then maize regeneration medium, containing imidazolinone as a selection agent. The Petri plates can be incubated in the light at 25° C. for 2-3 weeks, or until shoots develop. The green shoots can be transferred from each embryo to maize rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which can be PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants can exhibited similar phenotypes as the T1 plants. Hybrid plants (F1 progeny) of homozygous transgenic plants and non-transgenic plants can also exhibit increased similar phenotypes.

Example 14d

Engineering Wheat Plants by Over-Expressing the Polynucleotide Characterized in the Invention, e.g. Derived from *Saccharomyces cerevisiae*, *E. Coli* or Plants or Another Organism Transformation of wheat can be performed with the method described by Ishida et al. (1996 Nature Biotech. 14745-50). The cultivar Bobwhite (available from CYMMIT, Mexico) can commonly be used in transformation. Immature embryos can be co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

After incubation with *Agrobacterium*, the embryos can be grown on callus induction medium, then regeneration medium, containing imidazolinone as a selection agent. The Petri plates can be incubated in the light at 25° C. for 2-3 weeks, or until shoots develop. The green shoots can be transferred from each embryo to rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants exhibited similar phenotypes.

Example 14e

Engineering Rapeseed/Canola Plants by Over-Expressing the Polynucleotide Characterized in the Invention, e.g. Derived from *Saccharomyces cerevisiae*, *E. coli* or Plants or Another Organism Cotyledonary petioles and hypocotyls of 5-6 day-old young seedlings can be used as explants for tissue culture and transformed according to Babic et al. (1998, Plant Cell Rep 17: 183-188). The commercial cultivar Westar (Agriculture Canada) can be the standard variety used for transformation, but other varieties can be used.

*Agrobacterium tumefaciens* LBA4404 containing a binary vector can be used for canola transformation. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767, 366 and 6,225,105). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

Canola seeds can be surface-sterilized in 70% ethanol for 2 min., and then in 30% Clorox with a drop of Tween-20 for 10 min, followed by three rinses with sterilized distilled water. Seeds can be then germinated in vitro 5 days on half strength MS medium without hormones, 1% sucrose, 0.7% Phytagar at 23° C., 16 hr. light. The cotyledon petiole explants with the cotyledon attached can be excised from the in vitro seedlings, and can be inoculated with *Agrobacterium* by dipping the cut end of the petiole explant into the bacterial suspension. The explants can be then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants can be transferred to MSBAP-3 medium containing 3 mg/l BAP, cefotaxime, carbenicillin, or timentin (300 mg/l) for 7 days, and can then be cultured on MSBAP-3 medium with cefotaxime, carbenicillin, or timentin and selection agent until shoot regeneration. When the shoots are 5-10 mm in length, they can be cut and transferred to shoot elongation medium (MSBAP-0.5, containing 0.5 mg/l BAP). Shoots of about 2 cm in length can be transferred to the rooting medium (MS0) for root induction.

Samples of the primary transgenic plants (T0) can be analyzed by PCR to confirm the presence of T-DNA. These results can be confirmed by Southern hybridization in which DNA is electrophoresed on a 1 agarose gel and are transferred to a positively charged nylon membrane (Roche Diagnostics). The PCR DIG Probe Synthesis Kit (Roche Diagnostics) can be used to prepare a digoxigenin-labelled probe by PCR, and used as recommended by the manufacturer.

Example 14f

Engineering Alfalfa Plants by Over-Expressing the Polynucleotide Characterized in the Invention, e.g. Derived from *Saccharomyces cerevisiae* or *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) can be selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. The 34S promoter (GenBank Accession numbers M59930 and X16673) can be used to provide constitutive expression of the trait gene.

The explants can be cocultivated for 3 d in the dark on SH induction medium containing 288 mg/L Pro, 53 mg/L thioproline, 4.35 g/L K2SO4, and 100 µm acetosyringinone. The explants can be washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos can be transferred to BOi2Y development medium containing no growth regulators, no antibiotics, and 50 g/L sucrose. Somatic embryos are subsequently germinated on half-strength Murashige-Skoog medium. Rooted seedlings can be transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing the Polynucleotide Characterized in the Invention, Derived e.g. from *Saccharomyces cerevisiae*, *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 15

Metabolite Profiling Info from *Zea mays*

*Zea mays* plants were engineered, grown and analyzed as described in Example 14c.

The results of the different *Zea mays* plants analysed can be seen from Table 2 which follows:

TABLE 2

| ORF_NAME | Metabolite | Min | Max |
|---|---|---|---|
| b2414 | Methionine | 1.36 | 2.61 |

Table 2 exhibits the metabolic data from maize, shown in either T0 or T1, describing the increase in methionine in genetically modified corn plants expressing the *E. coli* nucleic acid sequence b2414.

In one embodiment, in case the activity of the *E. coli* protein b2414 or its homologs, e.g. "the activity of a subunit of cysteine synthase A and O-acetylserine sulfhydrolase A, PLP-dependent enzyme", is increased in corn plants, preferably, an increase of the fine chemical methionine between 36% and 161% is conferred.

Example 16

Preparation of Homologous Sequences from Plants

Different plants can be grown under standard or varying conditions in the greenhouse. RNA can be extracted following the protocol of Jones, Dunsmuir and Bedbrook (1985) EMBO J. 4: 2411-2418. Approx. 1 gram of tissue material from various organs is ground in liquid nitrogen. The powder is transferred to a 13 ml Falcon tube containing 4.5 ml NTES buffer (100 mM NaCl, 10 mM Tris/HCl pH 7.5, 1 mM EDTA, 1% SDS; in RNase-free water) and 3 ml phenol/chloroform/isoamylalcohol (25/24/1), immediately mixed and stored on ice. The mixture is spun for 10 minutes at 7000 rpm using a centrifuge (Sorval; SM24 or SS34 rotor). The supernatant is transferred to a new tube, 1/10th volume of 3 M NaAcetate (pH 5.2; in RNase-free water) and 1 volume of isopropanol is added, mixed at stored for 1 hour or overnight at −20° C. The mixture is spun for 10 minutes at 7000 rpm. The supernatant is discarded and the pellet washed with 70% ethanol (v/v). The mixture is spun for 5 minutes at 7000 rpm, the supernatant is discarded and the pellet is air-dried. 1 ml RNase-free water is added and allow the DNA/RNA pellet to dissolve on ice at 4 C. The nucleic acid solution is transferred to a 2 ml Eppendorf tube and 1 ml of 4 M LiAcetate is added. After mixing the solution is kept for at least 3 hours, or overnight, at 4 C. The mixture is spun for 10 minutes at 14000 rpm, the supernatant discarded, the pellet washed with 70% Ethanol, air-dried and dissolved in 200 µl of RNase-free water.

Total RNA can be used to construct a cDNA-library according to the manufacturer's protocol (for example using the ZAP-cDNA synthesis and cloning kit of Stratagene, La Jolla, USA). Basically, messenger RNA (mRNA) is primed in the first strand synthesis with a oligo(dT) linker—primer and is reverse-transcribed using reverse transcriptase. After second strand cDNA synthesis, the double-stranded cDNA is ligated into the Uni-ZAP XR vector. The Uni-ZAP XR vector allows in vivo excision of the pBluescript phagemid. The polylinker of the pBluescript phagemid has 21 unique cloning sites flanked by T3 and T7 promoters and a choice of 6 different primer sites for DNA sequencing. Systematic single run sequencing of the expected 5 prime end of the clones can allow preliminary annotation of the sequences for example with the help of the pedant pro Software package (Biomax, Munchen). Clones for the nucleic acids of the invention or used in the process according to the invention can be identified based on homology search with standard algorithms like blastp or gap. Identified putative full length clones with identity or high homology can be subjected to further sequencing in order to obtain the complete sequence.

Additional new homologous sequences can be identified in a similar manner by preparing respective cDNA libraries from various plant sources as described above. Libraries can then be screened with available sequences of the invention under low stringency conditions for example as described in Sambrook et al., Molecular Cloning: A laboratory manual, Cold Spring Harbor 1989, Cold Spring Harbor Laboratory Press. Purified positive clones can be subjected to the in vivo excision and complete sequencing. A pairwise sequence alignment of the original and the new sequence using the blastp or gap program allows the identification of orthologs, meaning homologous sequences from different organisms, which should have a sequence identity of at least 30%. Furthermore the conservation of functionally important amino acid residues or domains, which can be identified by the alignment of several already available paralogs, can identify a new sequence as an new orthologs.

Alternatively libraries can be subjected to mass sequencing and obtained sequences can be stored in a sequence database, which then can be screened for putative orthologs by different search algorithms, for example the tbastn algorithm to search the obtained nucleic acid sequences with a amino acid sequence of the invention. Clones with the highest sequence identity are used for a complete sequence determination and orthologs can be identified as described above.

Item 1. A process for the production of methionine, which comprises
  (a) increasing or generating the activity of a protein as indicated in Table II, columns 5 or 7, lines 1 to 5 and/or lines 334 to 338 or a functional equivalent thereof in a non-human organism, or in one or more parts thereof; and
  (b) growing the organism under conditions which permit the production of methionine in said organism.

Item 2. A process for the production of methionine, comprising the increasing or generating in an organism or a part thereof the expression of at least one nucleic acid molecule comprising a nucleic acid molecule selected from the group consisting of:

a) nucleic acid molecule encoding of a polypeptide as indicated in Table II, columns 5 or 7, lines 1 to 5 and/or lines 334 to 338 or a fragment thereof, which confers an increase in the amount of methionine in an organism or a part thereof;
b) nucleic acid molecule comprising of a nucleic acid molecule as indicated in Table I, columns 5 or 7, lines 1 to 5 and/or lines 334 to 338;
c) nucleic acid molecule whose sequence can be deduced from a polypeptide sequence encoded by a nucleic acid molecule of (a) or (b) as a result of the degeneracy of the genetic code and conferring an increase in the amount of methionine in an organism or a part thereof;
d) nucleic acid molecule which encodes a polypeptide which has at least 50% identity with the amino acid sequence of the polypeptide encoded by the nucleic acid molecule of (a) to (c) and conferring an increase in the amount of methionine in an organism or a part thereof;
e) nucleic acid molecule which hybridizes with a nucleic acid molecule of (a) to (c) under stringent hybridisation conditions and conferring an increase in the amount of methionine in an organism or a part thereof;
f) nucleic acid molecule which encompasses a nucleic acid molecule which is obtained by amplifying nucleic acid molecules from a cDNA library or a genomic library using the primers or primer pairs as indicated in Table III, columns 7, lines 1 to 5 and/or lines 334 to 338 and conferring an increase in the amount of the respective fine chemical in an organism or a part thereof;
g) nucleic acid molecule encoding a polypeptide which is isolated with the aid of monoclonal antibodies against a polypeptide encoded by one of the nucleic acid molecules of (a) to (f) and conferring an increase in the amount of methionine in an organism or a part thereof;
h) nucleic acid molecule encoding a polypeptide comprising a consensus sequence as indicated in Table IV, columns 7, lines 1 to 5 and/or lines 334 to 338 and conferring an increase in the amount of the respective fine chemical in an organism or a part thereof; and
i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the respective fine chemical in an organism or a part thereof.

or comprising a sequence which is complementary thereto.

Item 3. The process of iteml or 2, comprising recovering of the free or bound methionine.

Item 4. The process of any one of item 1 to 3, comprising the following steps:
(a) selecting an organism or a part thereof expressing a polypeptide encoded by the nucleic acid molecule characterized in item 2;
(b) mutagenizing the selected organism or the part thereof;
(c) comparing the activity or the expression level of said polypeptide in the mutagenized organism or the part thereof with the activity or the expression of said polypeptide of the selected organisms or the part thereof;
(d) selecting the mutated organisms or parts thereof, which comprise an increased activity or expression level of said polypeptide compared to the selected organism or the part thereof;
(e) optionally, growing and cultivating the organisms or the parts thereof; and
(f) recovering, and optionally isolating, the free or bound methionine produced by the selected mutated organisms or parts thereof.

Item 5. The process of any one of items 1 to 4, wherein the activity of said protein or the expression of said nucleic acid molecule is increased or generated transiently or stably.

Item 6. An isolated nucleic acid molecule comprising a nucleic acid molecule selected from the group consisting of:
a) nucleic acid molecule encoding of a polypeptide as indicated in Table II, columns 5 or 7, lines 1 to 5 and/or lines 334 to 338 or a fragment thereof, which confers an increase in the amount of methionine in an organism or a part thereof;
b) nucleic acid molecule comprising of a nucleic acid molecule as indicated in Table I, columns 5 or 7, lines 1 to 5 and/or lines 334 to 338;
c) nucleic acid molecule whose sequence can be deduced from a polypeptide sequence encoded by a nucleic acid molecule of (a) or (b) as a result of the degeneracy of the genetic code and conferring an increase in the amount of methionine in an organism or a part thereof;
d) nucleic acid molecule which encodes a polypeptide which has at least 50% identity with the amino acid sequence of the polypeptide encoded by the nucleic acid molecule of (a) to (c) and conferring an increase in the amount of methionine in an organism or a part thereof;
e) nucleic acid molecule which hybridizes with a nucleic acid molecule of (a) to (c) under stringent hybridisation conditions and conferring an increase in the amount of methionine in an organism or a part thereof;
f) nucleic acid molecule which encompasses a nucleic acid molecule which is obtained by amplifying nucleic acid molecules from a cDNA library or a genomic library using the primers or primer pairs as indicated in Table III, columns 7, lines 1 to 5 and/or lines 334 to 338 and conferring an increase in the amount of the respective fine chemical in an organism or a part thereof;
g) nucleic acid molecule encoding a polypeptide which is isolated with the aid of monoclonal antibodies against a polypeptide encoded by one of the nucleic acid molecules of (a) to (f) and conferring an increase in the amount of methionine in an organism or a part thereof;
h) nucleic acid molecule encoding a polypeptide comprising a consensus sequence as indicated in Table IV, columns 7, lines 1 to 5 and/or lines 334 to 338 and conferring an increase in the amount of the respective fine chemical in an organism or a part thereof; and
i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the respective fine chemical in an organism or a part thereof.

whereby the nucleic acid molecule distinguishes over the sequence as indicated in Table I A, columns 5 or 7, lines 1 to 5 and/or lines 334 to 338 by one or more nucleotides.

Item 7. A nucleic acid construct which confers the expression of the nucleic acid molecule of item 6, comprising one or more regulatory elements.

Item 8. A vector comprising the nucleic acid molecule as defined in item 6 or the nucleic acid construct of item 7.

Item 9. The vector as defined in item 8, wherein the nucleic acid molecule is in operable linkage with regulatory sequences for the expression in a prokaryotic or eukaryotic, or in a prokaryotic and eukaryotic, host.

Item 10. A host cell, which has been transformed stably or transiently with the vector as defined in item 8 or 9 or the nucleic acid molecule as defined in item 6 or the nucleic acid construct of item 7 or produced as described in item any one of items 2 to 5.

Item 11. The host cell of item 10, which is a transgenic host cell.

Item 12. The host cell of item 10 or 11, which is a plant cell, an animal cell, a microorganism, or a yeast cell, a fungus cell, a prokaryotic cell, an eukaryotic cell or an archaebacterium.

Item 13. A process for producing a polypeptide, wherein the polypeptide is expressed in a host cell as defined in any one of items 10 to 12.

Item 14. A polypeptide produced by the process as defined in item 13 or encoded by the nucleic acid molecule as defined in item 6 whereby the polypeptide distinguishes over a sequence as indicated in Table II A, columns 5 or 7, lines 1 to 5 and/or lines 334 to 338 by one or more amino acids.

Item 15. An antibody, which binds specifically to the polypeptide as defined in item 14.

Item 16. A plant tissue, propagation material, harvested material or a plant comprising the host cell as defined in item 12 which is plant cell or an *Agrobacterium*.

Item 17. A method for screening for agonists and antagonists of the activity of a polypeptide encoded by the nucleic acid molecule of item 6 conferring an increase in the amount of methionine in an organism or a part thereof comprising:
  (a) contacting cells, tissues, plants or microorganisms which express the a polypeptide encoded by the nucleic acid molecule of item 5 conferring an increase in the amount of methionine in an organism or a part thereof with a candidate compound or a sample comprising a plurality of compounds under conditions which permit the expression the polypeptide;
  (b) assaying the methionine level or the polypeptide expression level in the cell, tissue, plant or microorganism or the media the cell, tissue, plant or microorganisms is cultured or maintained in; and
  (c) identifying a agonist or antagonist by comparing the measured methionine level or polypeptide expression level with a standard methionine or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Item 18. A process for the identification of a compound conferring increased methionine production in a plant or microorganism, comprising the steps:
  (a) culturing a plant cell or tissue or microorganism or maintaining a plant expressing the polypeptide encoded by the nucleic acid molecule of item 6 conferring an increase in the amount of methionine in an organism or a part thereof and a readout system capable of interacting with the polypeptide under suitable conditions which permit the interaction of the polypeptide with dais readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of item 6 conferring an increase in the amount of methionine in an organism or a part thereof;
  (b) identifying if the compound is an effective agonist by detecting the presence or absence or increase of a signal produced by said readout system.

Item 19. A method for the identification of a gene product conferring an increase in methionine production in a cell, comprising the following steps:
  (a) contacting the nucleic acid molecules of a sample, which can contain a candidate gene encoding a gene product conferring an increase in methionine after expression with the nucleic acid molecule of item 6;
  (b) identifying the nucleic acid molecules, which hybridise under relaxed stringent conditions with the nucleic acid molecule of item 6;
  (c) introducing the candidate nucleic acid molecules in host cells appropriate for producing methionine;
  (d) expressing the identified nucleic acid molecules in the host cells;
  (e) assaying the methionine level in the host cells; and
  (f) identifying nucleic acid molecule and its gene product which expression confers an increase in the methionine level in the host cell in the host cell after expression compared to the wild type.

Item 20. A method for the identification of a gene product conferring an increase in methionine production in a cell, comprising the following steps:
  (a) identifying in a data bank nucleic acid molecules of an organism; which can contain a candidate gene encoding a gene product conferring an increase in the methionine amount or level in an organism or a part thereof after expression, and which are at least 20% homolog to the nucleic acid molecule of item 6;
  (b) introducing the candidate nucleic acid molecules in host cells appropriate for producing methionine;
  (c) expressing the identified nucleic acid molecules in the host cells;
  (d) assaying the methionine level in the host cells; and
  (e) identifying nucleic acid molecule and its gene product which expression confers an increase in the methionine level in the host cell after expression compared to the wild type.

Item 21. A method for the production of an agricultural composition comprising the steps of the method of any one of items 17 to 20 and formulating the compound identified in any one of items 17 to 20 in a form acceptable for an application in agriculture.

Item 22. A composition comprising the nucleic acid molecule of item 6, the polypeptide of item 14, the nucleic acid construct of item 7, the vector of any one of items 8 or 9, an antagonist or agonist identified according to item 17, the compound of item 18, the gene product of item 19 or 20, the antibody of item 15, and optionally an agricultural acceptable carrier.

Item 23. Use of the nucleic acid molecule as defined in item 6 for the identification of a nucleic acid molecule conferring an increase of methionine after expression.

Item 24. Use of the polypeptide of item 14 or the nucleic acid construct item 7 or the gene product identified according to the method of item 19 or 20 for identifying compounds capable of conferring a modulation of methionine levels in an organism.

Item 25. Food or feed composition comprising the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 16, the host cell of item 10 to 12 or the gene product identified according to the method of item 19 or 20.

The present invention relates to a process for the production of the fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

In a further embodiment, the present invention relates to a further process for the production of fine chemicals as defined below and corresponding embodiments as described herein as follows.

The present invention relates to a process for the production of a fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other substances described in Ullmann's Encyclopedia of Industrial Chemistry, vol. A2, pp. 57-97, VCH Weinheim, 1985.

Over one million tons of amino acids are currently produced annually; their market value amounts to over 2.5 billion US dollars. They are currently produced by four competing processes: Extraction from protein hydrolysates, for example L-cystine, L-leucine or L-tyrosine, chemical synthesis, for example of D-, L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is Corynebacterium glutamicum, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterized thoroughly; for a review of the bacterial amino acid biosynthesis and its regulation, see Umbarger, H. E. (1978) Ann. Rev. Biochem. 47: 533-606.

It is known that amino acids are produced by fermentation of strains of coryneform bacteria, in particular *Corynebacterium glutamicum*. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as *Escherichia* or *Bacillus* are also used for the production of amino acids. A number of mutant strains, which produce an assortment of desirable compounds from the group of the sulfur-containing fine chemicals, have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetyl-norleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082,993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases special enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenesis of plant and selection afterwards with inhibitors of certain enzymes of amino acid biosynthetic pathway.

Following the approach of deregulating specific enzymes in the amino acid biosynthetic pathway an increase of the levels of free threonine is disclosed in U.S. Pat. No. 5,942,660 which is achieved by overexpression of either a wild-type or deregulated aspartate kinase, homoserine dehydrogenase or threonine synthase.

Methods of recombinant DNA technology have also been used for some years to improve *Corynebacterium* strains producing L-amino acids by amplifying individual amino acid biosynthesis genes and investigating the effect on amino acid production.

As described above, the essential amino acids are necessary for humans and many mammals, for example for livestock. Threonine is an important constituent in many body proteins and is necessary for the formation of tooth enamel protein, collagen and elastin, which both needed for healthy skin and wound healing. It is a precursor to the amino acids glycine and serine. It acts as a lipotropic in controlling fat build-up in the liver. Threonine is an immune stimulant because it promotes thymus growth and activity. It is a component of digestive enzymes and immune secretions from the gut, particularly mucins. It has been used as a supplement to help alleviate anxiety and some cases of depression. In animal production, as an important essential amino acid, threonine is normally the second limiting amino acid for pigs and the third limiting amino acid for chicken (*Gallus gallus* f. *domestica*, e.g. laying hen or broiler).

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add a plurality of amino acids in a balanced manner to suit the organism.

It is an object of the present invention to develop an inexpensive process for the synthesis of threonine, preferably L-threonine. Threonine is together with lysine and methionine (depending on the organism) one of the amino acids which are most frequently limiting.

It was now found that this object is achieved by providing the process according to the invention described herein and the embodiments characterized in the claims.

Accordingly, in a first embodiment, the invention relates to a process for the production of a fine chemical, whereby the fine chemical is threonine, preferably L-threonine. Accordingly, in the present invention, the term "the fine chemical" as used herein relates to "threonine". Further, the term "the fine chemicals" as used herein also relates to fine chemicals comprising threonine.

In one embodiment, the term "the fine chemical" means threonine, preferably L-threonine. Throughout the specification the term "the fine chemical" means threonine, preferably L-threonine, its salts, ester or amides in free form or bound to proteins. In a preferred embodiment, the term "the fine chemical" means threonine, preferably L-threonine, in free form or its salts or bound to proteins.

Accordingly, the present invention relates to a process comprising
(a) increasing or generating the activity of one or more YFL050C, YKR057W, YIL150C, YNL046W, YNL120C, b0186, b0730, b1829, b2170, b0019, b0464, b1360, b1738, b1830, b1896, b2270, b2414, b2552, b2664, b3074, b3160, b3231, b3462, b3791, b3966, b4004, YOR245C—protein(s) in a non-human organism in one or more parts thereof and
(b) growing the organism under conditions which permit the production of the fine chemical, thus, threonine or fine chemicals comprising threonine, in said organism.

Accordingly, the present invention relates to a process for the production of a fine chemical comprising
(a) increasing or generating the activity of one or more proteins having the activity of a protein indicated in Table IIA or IIB, column 3, lines 6 to 15, 339 to 355 or having the sequence of a polypeptide encoded by a nucleic acid molecule indicated in Table IA or IB, column 5 or 7, lines 6 to 15, 339 to 355, in a non-human organism in one or more parts thereof and
(b) growing the organism under conditions which permit the production of the fine chemical, in particular threonine.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

The term "Table I" used in this specification is to be taken to specify the content of Table I A and Table I B. The term "Table II" used in this specification is to be taken to specify the content of Table II A and Table II B. The term "Table I A" used in this specification is to be taken to specify the content of Table I A. The term "Table I B" used in this specification is to be taken to specify the content of Table I B. The term "Table II A" used in this specification is to be taken to specify the content of Table II A. The term "Table II B" used in this specification is to be taken to specify the content of Table II B. In one preferred embodiment, the term "Table I" means Table I B. In one preferred embodiment, the term "Table II" means Table II B.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein having the activity of a protein indicated in Table IIA or IIB, column 3, lines 6 to 15, 339 to 355 or encoded by nucleic acid molecule indicated in Table IIA or IIB, columns 5 or 7, lines 6 to 15, 339 to 355.

Surprisingly it was found, that the transgenic expression of at least one of the *Saccaromyces* cerevisiae protein(s) indicated in Table IIA or IIB, Column 3, lines 6 to 10 and line 355 and/or at least one of the *Escherichia coli* K12 proteins indicated in Table IIA or IIB, Column 3, line 11-15, 339 to 354 in *Arabidopsis thaliana* conferred an increase in the threonine (or fine chemical) content of the transformed plants.

In accordance with the invention, the term "organism" as understood herein relates always to a non-human organism, in particular to an animal or plant organism or to a microorganism. Further, the term "animal" as understood herein relates always to a non-human animal.

In accordance with the invention it is known to the skilled that anionic compounds such as acids are present in aqueous solutions in an equilibrium between the acid and its salts according to the pH present in the respective compartment of the cell or organism and the pK of the acid. Depending on the strength of the acid (pK) and the pH the salt or the free acid are predominant. Thus, the term "the fine chemical", the term "the respective fine chemical", or the term "acid" or the use of a denomination referring to a neutralized anionic compound relates to the anionic form as well as the neutralised status of that compound according to the milieu of the aqueous solution in which they are present.

The sequence of YFL050C from *Saccharomyces cerevisiae* has been published in Murakami et al., Nat. Genet. 10 (3), 261-268, 1995 and Goffeau et al., Science 274 (5287), 546-547, 1996, and its activity is defined as a di-trivalent inorganic cation transporter. Accordingly, in one embodiment, the process of the present invention comprises the use of a gene product defined as di-trivalent inorganic cation transporter from *Saccharomyces* cerevisiae or its homolog, e.g. as shown herein, for the production of the fine chemical, meaning threonine, in particular for increasing the amount of threonine, preferably L-threonine in free or bound form in an organism or a part thereof, as mentioned.

The sequence of YKR057W from *Saccharomyces cerevisiae* has been published in Dujon et al., Nature 369 (6479), 371-378, 1994 and Goffeau et al., Science 274 (5287), 546-547, 1996 and its activity is being defined as an ribosomal protein, similar to S21 ribosomal proteins, involved in ribosome biogenesis and translation. Accordingly, in one embodiment, the process of the present invention comprises the use of a ribosomal protein, similar to S21 ribosomal proteins, involved in ribosome biogenesis and translation from *Saccaromyces* cerevisiae or its homolog, e.g. as shown herein, for the production of the fine chemical, meaning of threonine, in particular for increasing the amount of threonine, preferably L-threonine in free or bound form in an organism or a part thereof, as mentioned.

The sequence of YIL150C from *Saccharomyces cerevisiae* has been published in Goffeau et al., Science 274 (5287), 546-547, 1996 and Churcher et al., Nature 387 (6632 Suppl), 84-87, 1997 and its activity is being defined as a chromatin binding protein, required for S-phase (DNA synthesis) initiation or completion. Accordingly, in one embodiment, the process of the present invention comprises the use of a chromatin binding protein, required for S-phase (DNA synthesis) initiation or completion, from *Saccharomyces* cerevisiae or its homolog, e.g. as shown herein, for the production of the fine chemical, meaning of threonine, in particular for increasing the amount of threonine, preferably L-threonine in free or bound form in an organism or a part thereof, as mentioned.

The sequence of YNL046W from *Saccharomyces cerevisiae* has been published in Goffeau et al., Science 274 (5287), 546-547, 1996 and Philippsen et al., Nature 387 (6632 Suppl), 93-98, 1997 and its activity is being defined as a probable membrane protein of the endoplasmatic reticulum. Accordingly, in one embodiment, the process of the present invention comprises the use of a YNL046W, as a probable membrane protein of the endoplasmatic reticulum, from *Saccaromyces* cerevisiae or its homolog, e.g. as shown herein, for the production of the fine chemical, meaning of threonine, in particular for increasing the amount of threonine, preferably threonine in free or bound form in an organism or a part thereof, as mentioned.

The sequence of YNL120C from *Saccharomyces cerevisiae* has been published in de Antoni et al, Yeast 13:261-266, 1997, and its cellular activity has not been characterized yet. Accordingly, in one embodiment, the process of the present invention comprises the use of a YNL120C activity from *Saccaromyces* cerevisiae or its homolog, e.g. as shown herein, for the production of the fine chemical, meaning of threonine, in particular for increasing the amount of threonine, preferably threonine in free or bound form in an organism or a part thereof, as mentioned.

The sequence of b0186 from *Escherichia coli* K12 has been published in Blattner et al., Science 277(5331), 1453-1474, 1997, and its activity is being defined as a lysine decarboxylase. Accordingly, in one embodiment, the process of the present invention comprises the use of a lysine decarboxylase from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a lysine decarboxylase is increased or generated, e.g. from *E. coli* or a homolog thereof.

The sequence of b0730 from *Escherichia coli* K12 has been published in Blattner et al., Science 277(5331), 1453-1474, 1997, and its activity is being defined as transcriptional regulator of succinylCoA synthetase operon and fatty acyl response regulator. Accordingly, in one embodiment, the process of the present invention comprises the use of a transcriptional regulator of succinylCoA synthetase operon or a fatty acid response regulator from *E. coli* or its homolog, e.g. as shown herein, for the production of the fine chemical, meaning of threonine, in particular for increasing the amount of threonine, preferably L-threonine in free or bound form in an organism or a part thereof, as mentioned.

The sequence of b1829 from *Escherichia coli* K12 has been published in Blattner et al., Science 277(5331), 1453-1474, 1997, and its activity is being defined as a heat shock protein. Accordingly, in one embodiment, the process of the present invention comprises the use of a "heat shock protein" from *E. coli* or its homolog, e.g. as shown herein, for the production of the fine chemical, meaning of threonine, in particular for increasing the amount of threonine in free or bound form in an organism or a part thereof, as mentioned. In one embodiment, in the process of the present invention the activity of a htpX heat shock protein is increased or generated, e.g. from *E. coli* or a homolog thereof. The htpX heat shock protein is also annotated as having a protease activity. Accordingly, in one embodiment, in the process of the present invention the activity of a protease, preferably of a heat shock protease, more preferred of a htpX protease or its homolog is increased for the production of the fine chemical, meaning of threonine, in particular for increasing the amount of threonine in free or bound form in an organism or a part thereof, as mentioned.

The sequence of b2170 from *Escherichia coli* K12 has been published in Blattner et al, Science 277(5331), 1453-1474, 1997, and its activity is being defined as a sugar efflux transporter. Accordingly, in one embodiment, the process of the present invention comprises the use of a sugar efflux transporter B from *E. coli* or its homolog, e.g. as shown herein, for the production of the fine chemical, meaning of threonine, in particular for increasing the amount of threonine, preferably L-threonine in free or bound form in an organism or a part thereof, as mentioned.

The sequence of b0019 from *Escherichia coli* K12 has been published in Blattner et al., Science 277(5331), 1453-1474, 1997, and its activity is being defined as protein for the transport; the transport of small molecules, preferably cations. In a more preferred embodiment the protein has the activity of a Na+/H+ antiporter, responsive to stress, especially to high salinity and pH. Accordingly, in one embodiment, the process of the present invention comprises the use of a protein for the transport; preferably a stress responsive Na+/H+ antiporter from *E. coli* or its homolog, e.g. as shown herein, for the production of the fine chemical, meaning of threonine, in particular for increasing the amount of threonine, preferably L-threonine in free or bound form in an organism or a part thereof, as mentioned.

The sequence of b0464 from *Escherichia coli* K12 has been published in Blattner et al., Science 277(5331), 1453-1474, 1997, and its activity is being defined as a transcriptional repressor for multidrug efflux pump (TetR/AcrR family). Accordingly, in one embodiment, the process of the present invention comprises the use of a transcriptional repressor for multidrug efflux pump (TetR/AcrR family) from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a transcriptional repressor for multidrug efflux pump (TetR/AcrR family) is increased or generated, e.g. from *E. coli* or a homolog thereof.

The sequence of b1360 from *Escherichia coli* K12 has been published in Blattner et al., Science 277(5331), 1453-1474, 1997, and its activity is being defined as a putative DNA replication protein. Accordingly, in one embodiment, the process of the present invention comprises the use of a putative DNA replication protein from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a putative DNA replication protein is increased or generated, e.g. from *E. coli* or a homolog thereof.

The sequence of b1738 from *Escherichia coli* K12 has been published in Blattner et al., Science 277(5331), 1453-1474, 1997, and its activity is being defined as a PEP-dependent phosphotransferase. Accordingly, in one embodiment, the process of the present invention comprises the use of a PEP-dependent phosphotransferase from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a PEP-dependent phosphotransferase is increased or generated, e.g. from *E. coli* or a homolog thereof.

The sequence of b1830 from *Escherichia coli* K12 has been published in Blattner et al., Science 277(5331), 1453-1474, 1997, and its activity is being defined as a carboxy-terminal protease for penicillin-binding protein 4. Accordingly, in one embodiment, the process of the present invention comprises the use of a carboxy-terminal protease for penicillin-binding protein 4 from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a carboxy-terminal protease for penicillin-binding protein 4 is increased or generated, e.g. from *E. coli* or a homolog thereof.

The sequence of b1896 from *Escherichia coli* K12 has been published in Blattner et al., Science 277(5331), 1453-1474, 1997, and its activity is being defined as a trehalose-6-phosphate synthase. Accordingly, in one embodiment, the process of the present invention comprises the use of a trehalose-6-phosphate synthase from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a trehalose-6-phosphate synthase is increased or generated, e.g. from *E. coli* or a homolog thereof.

The sequence of b2414 from *Escherichia coli* K12 has been published in Blattner et al., Science 277(5331), 1453-1474, 1997, and its activity is being defined as a subunit of cysteine synthase A and O-acetylserine sulfhydrolase A, PLP-dependent enzyme. Accordingly, in one embodiment, the process of the present invention comprises the use of a subunit of cysteine synthase A and O-acetylserine sulfhydrolase A, PLP-dependent enzyme from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a subunit of cysteine synthase A and O-acetylserine sulfhydrolase A, PLP-dependent enzyme is increased or generated, e.g. from *E. coli* or a homolog thereof.

The sequence of b2552 from *Escherichia coli* K12 has been published in Blattner et al., Science 277(5331), 1453-1474, 1997, and its activity is being defined as a dihydropteridine reductase (nitric oxide dioxygenase). Accordingly, in one embodiment, the process of the present invention comprises the use of a dihydropteridine reductase (nitric oxide dioxygenase) from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a dihydropteridine reductase (nitric oxide dioxygenase) is increased or generated, e.g. from *E. coli* or a homolog thereof.

The sequence of b4004 from *Escherichia coli* K12 has been published in Blattner et al.,
Science 277(5331), 1453-1474, 1997, and its activity is being defined as a transcriptional regulatory protein. Accordingly, in one embodiment, the process of the present invention comprises the use of a transcriptional regulatory protein from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a transcriptional regulatory protein is increased or generated, e.g. from *E. coli* or a homolog thereof.

The sequence of b2664 from *Escherichia coli* K12 has been published in Blattner et al., Science 277(5331), 1453-1474, 1997, and its activity is being defined as a putative transcriptional repressor with DNA-binding Winged helix domain (GntR familiy). Accordingly, in one embodiment, the process of the present invention comprises the use of a putative transcriptional repressor with DNA-binding Winged helix domain (GntR familiy) from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a putative transcriptional repressor with DNA-binding Winged helix domain (GntR familiy) is increased or generated, e.g. from *E. coli* or a homolog thereof.

The sequence of b3074 from *Escherichia coli* K12 has been published in Blattner et al., Science 277(5331), 1453-1474, 1997, and its activity is being defined as a putative tRNA synthetase. Accordingly, in one embodiment, the process of the present invention comprises the use of a putative tRNA synthetase from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a putative tRNA synthetase is increased or generated, e.g. from *E. coli* or a homolog thereof.

The sequence of b2270 from *Escherichia coli* K12 has been published in Blattner et al., Science 277(5331), 1453-1474, 1997, and its activity has not been characterized yet. Accordingly, in one embodiment, the process of the present invention comprises the use of a protein b2270 from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of the protein encoded by b2270 is increased or generated, e.g. from *E. coli* or a homolog thereof.

The sequence of b3160 from *Escherichia coli* K12 has been published in Blattner et al., Science 277(5331), 1453-1474, 1997, and its activity is being defined as a putative monooxygenase with luciferase-like ATPase activity. Accordingly, in one embodiment, the process of the present invention comprises the use of a putative monooxygenase with luciferase-like ATPase activity from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a putative monooxygenase with luciferase-like ATPase activity is increased or generated, e.g. from *E. coli* or a homolog thereof.

The sequence of b3231 from *Escherichia coli* K12 has been published in Blattner et al., Science 277(5331), 1453-1474, 1997, and its activity is being defined as a 50S ribosomal subunit protein L13. Accordingly, in one embodiment, the process of the present invention comprises the use of a 50S ribosomal subunit protein L13 from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a 50S ribosomal subunit protein L13 is increased or generated, e.g. from *E. coli* or a homolog thereof.

The sequence of b3462 from *Escherichia coli* K12 has been published in Blattner et al., Science 277(5331), 1453-1474, 1997, and its activity is being defined as an integral membrane cell division protein. Accordingly, in one embodiment, the process of the present invention comprises the use of a integral membrane cell division protein from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a integral membrane cell division protein is increased or generated, e.g. from *E. coli* or a homolog thereof.

The sequence of b3791 from *Escherichia coli* K12 has been published in Blattner et al., Science 277(5331), 1453-1474, 1997, and its activity is being defined as a transaminase involved in lipopolysaccharide biosynthesis. Accordingly, in one embodiment, the process of the present invention comprises the use of a transaminase involved in lipopolysaccharide biosynthesis from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a transaminase involved in lipopolysaccharide biosynthesis is increased or generated, e.g. from *E. coli* or a homolog thereof.

The sequence of b3966 from *Escherichia coli* K12 has been published in Blattner et al., Science 277(5331), 1453-1474, 1997, and its activity is being defined as an outer membrane porin. Accordingly, in one embodiment, the process of the present invention comprises the use of a outer membrane porin from *E. coli* or its homolog, e.g. as shown herein, for the production of the fine chemical, meaning of threonine, in particular for increasing the amount of threonine, preferably threonine in free or bound form in an organism or a part thereof, as mentioned. In one embodiment, in the process of the present invention the activity of a outer membrane porin is increased or generated, e.g. from *E. coli* or a homolog thereof.

The sequence of YOR245c from *Saccharomyces cerevisiae* has been published in Dujon, B. et al., Nature 387 (6632 Suppl), 98-102 (1997) and its activity is defined as a acyl-CoA:diacylglycerol acyltransferase. Accordingly, in one embodiment, the process of the present invention comprises the use of a gene product defined as a acyl-CoA:diacylglycerol acyltransferase from *Saccaromyces* cerevisiae or its homolog, e.g. as shown herein, for the production of the fine chemical, meaning threonine, in particular for increasing the amount of threonine, preferably L-threonine in free or bound form in an organism or a part thereof, as mentioned. In one embodiment, in the process of the present invention the activity of a acyl-CoA:diacylglycerol acyltransferase is increased or generated, e.g. from *Saccharomyces cerevisiae* or a homolog thereof.

Homologues (=homologs) of the present gene products can be derived from any organisms as long as the homologue confers the herein mentioned activity, in particular, confers an increase in the fine chemical amount or content. Further, in the present invention, the term "homologue" relates to the sequence of an organism having the highest sequence homology to the herein mentioned or listed sequences of all expressed sequences of said organism. However, the person skilled in the art knows, that, preferably, the homologue has said the-fine-chemical-increasing activity and, if known, the same biological function or activity in the organism as at least one of the protein(s) indicated in Table IIA or IIB, Column 3, lines 6 to 15, 339 to 355, e.g. having the sequence of a polypeptide encoded by a nucleic acid molecule comprising the sequence indicated in in Table IA or IB, Column 5 or 7, lines 6 to 15, 339 to 355. In one embodiment, the homolog of any one of the polypeptides indicated in Table IIA or IIB, lines 6 to 10, 339 to 355 is a homolog having the same or a similar activity, in particular an increase of activity confers an increase in the content of the fine chemical in the organsims and being derived from an eukaryot. In one embodiment, the homolog of a polypeptide indicated in Table IIA or IIB, column 3, lines 11 to 15, 339 to 355 is a homolog having the same or a similar activity, in particular an increase of activity confers an increase in the content of the fine chemical in the organisms or part thereof, and being derived from bacteria. In one embodiment, the homolog of a polypeptide indicated in Table IIA or IIB, column 3, lines 6 to 10, 339 to 355 is a homolog having the same or a similar activity, in particular an increase of activity confers an increase in the content of the fine chemical in an organisms or part thereof, and being derived from Fungi. In one embodiment, the homolog of a polypeptide indicated in Table IIA or IIB, column 3, lines 11 to 15, 339 to 355 is a homolog having the same or a similar activity, in particular an increase of activity confers an increase in the content of the fine chemical in the organisms or part thereof and being derived from Proteobacteria. In one embodiment, the homolog of a polypeptide indicated in Table IIA or IIB, column 3, lines 6 to 10, 339 to 355 is a homolog having the same or a similar activity, in particular an increase of activity confers an increase in the content of the fine chemical in the organisms or a part thereof and being derived from Ascomyceta. In one embodiment, the homolog of a polypeptide indicated in Table IIA or IIB, column 3, lines 11 to 15, 339 to 355 is a homolog having the same or a similar activity, in particular an increase of activity confers an increase in the content of the fine chemical in the organisms or part thereof, and being derived from Gammaproteobacteria. In one embodiment, the homolog of a polypeptide polypeptide indicated in Table IIA or IIB, column 3, lines 6 to 10, 339 to 355 is a homolog having the same or a similar activity, in particular an increase of activity confers an increase in the content of the fine chemical in the organisms or part thereof, and being derived from Saccharomycotina. In one embodiment, the homolog of a polypeptide indicated in Table IIA or IIB, column 3, lines 11 to 15, 339 to 355 is a homolog having the same or a similar activity, in particular an increase of activity confers an increase in the content of the fine chemical in the organisms or part thereof, and being derived from Enterobacteriales. In one embodiment, the homolog of a polypeptide indicated in Table IIA or IIB, column 3, lines 6 to 15, 339 to 355 is a homolog having the same or a similar activity, in particular an increase of activity confers an increase in the content of the fine chemical in the organisms or a part thereof, and being derived from Saccharomycetes. In one embodiment, the homolog of a polypeptide indicated in Table IIA or IIB, column 3, lines 11 to 15, 339 to 354 is a homolog having the same or a similar activity, in particular an increase of activity confers an increase in the content of the fine chemical in the organisms or part thereof, and being derived from Enterobacteriaceae. In one embodiment, the homolog of a polypeptide indicated in Table IIA or IIB, column 3, lines 6 to 10, 355 is a homolog having the same or a similar activity, in particular an increase of activity confers an increase in the content of the fine chemical in the organisms, and being derived from Saccharomycetales. In one embodiment, the homolog of a polypeptide indicated in Table IIA or IIB, column 3, lines 11 to 15, 339 to 354 is a homolog having the same or a similar activity, in particular an increase of activity confers an increase in the content of the fine chemical in the organisms or a part thereof, and being derived from *Escherichia*. In one embodiment, the homolog of a polypeptide indicated in Table IIA or IIB, column 3, lines 6 to 10, 355 is a homolog having the same or a similar activity, in particular an increase of activity confers an increase in the content of the fine chemical in the organisms or a part thereof, and being derived from Saccharomycetaceae. In one embodiment, the homolog of a polypeptide indicated in Table IIA or IIB, column 3, line 6 to 10, 355 is a homolog having the same or a similar activity, in particular an increase of activity confers an increase in the content of the fine chemical in the organisms or a part thereof, and being derived from Saccharomycetes.

Homologs of the polypeptides polypeptide indicated in Table IIA or IIB, column 3, lines 6 to 15, 339 to 355 may be the polypetides encoded by the nucleic acid molecules polypeptide indicated in Table IA or IB, column 7, lines 6 to 10, 339 to 355 or may be the polypeptides indicated in Table IIA or IIB, column 7, lines 6 to 10, 339 to 355. Homologs of the polypeptides polypeptide indicated in Table IIA or IIB, column 3, lines 6 to 15, 339 to 355 may be the polypeptides encoded by the nucleic acid molecules polypeptide indicated in Table IA or IB, column 7, lines 6 to 10, 339 to 355 or may be the polypeptides indicated in Table IIA or IIB, column 7, lines 11-15, 339 to 355.

Further homologs of are described herein below.

In accordance with the invention, a protein or polypeptide has the "activity of an protein of the invention", e.g. the activity of a protein indicated in Table IIA or IIB, column 3, lines 6 to 15, 339 to 355 if its de novo activity, or its increased expression directly or indirectly leads to an increased threonine level in the organism or a part thereof, preferably in a cell of said organism Throughout the specification the activity or preferably the biological activity of such a protein or polypeptide or an nucleic acid molecule or sequence encoding such protein or polypeptide is identical or similar if it still has the biological or enzymatic activity of any one of the proteins indicated in Table IIA or IIB, column 3, lines 6 to 15, 339 to 355, i.e. or which has at least 10% of the original enzymatic activity, preferably 20%, particularly preferably 30%, most particularly preferably 40% in comparison to an any one of the proteins indicated in Table IIA or IIB, column 3, lines 6 to 10, 339 to 355 and/or any one of the proteins indicated in Table IIA or IIB, column 3, lines 11 to 15, 339 to 354.

In one embodiment, the polypeptide of the invention confers said activity, e.g. the increase of the fine chemical in an organism or a part thereof, if it is derived from an organism, which is evolutionary distant to the organism in which it is expressed. For example origin and expressing organism are derived from different families, orders, classes or phylums.

The terms "increased", "rose", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change or the modulation of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild type cell.

However, the terms increase or decrease as used herein also include the change or modulation of a property in the whole organism as mentioned.

Accordingly, the term "increase" or "decrease" means that the specific activity of an enzyme, preferably the amount of a compound or metabolite, e.g. of a polypeptide, a nucleic acid molecule or of the respective fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control, or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control, or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99,00%, in particular 99.10%, 99.30%, 99.50%, 99.70%, 99.90%, 99.99%, 99.999% or more.

Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention, e.g., it differs by or in the expression level or activity of an protein having the activity of protein as indicated in Table IIA or IIB, column 3, lines 6 to 15, 339 to 355 or being encoded by a nucleic acid molecule indicated in Table IA or IB, column 5, lines 6 to 15, 339 to 355 or its homologs, e.g. as indicated in Table IA or IB, column 7, lines 6 to 15, 339 to 355, its biochemical or genetical causes and therefore shows the increased amount of the fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of a protein, e.g. the polypeptide of the invention or the polypeptide used in the method of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by amplifying the number of gene(s), by modifying the regulation of the gene, or by increasing the stability of the corresponding mRNA or of the corresponding gene product encoded by the nucleic acid molecule of the invention or the nucleic acid molecule used in the method of the invention, or by introducing homologous genes from other organisms which are differently regulated, e.g. not feedback sensitive.

This also applies analogously to the combined increased expression of the nucleic acid molecule of the present invention or its gene product with that of further enzymes or regulators of the biosynthesis pathways of the respective fine chemical, e.g. which are useful for the synthesis of the respective fine chemicals.

The increase, decrease or modulation according to this invention can be constitutive, e.g. due to a stable permanent transgenic expression or to a stable mutation in the corresponding endogenous gene encoding the nucleic acid molecule of the invention or the nucleic acid molecule used in the method of the invention or to a modulation of the expression or of the behaviour of a gene conferring the expression of the polypeptide of the invention or the polypeptide used in the method of the invention, or transient, e.g. due to an transient transformation or temporary addition of a modulator such as a agonist or antagonist or inducible, e.g. after transformation with a inducible construct carrying the nucleic acid molecule of the invention or the nucleic acid molecule used in the method of the invention under control of a inducible promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the respective fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In one embodiment, in case the activity of the *Saccharomyces cerevisiae* protein YFL050C or di-trivalent inorganic cation transporter or its homologs, e.g. as indicated in Table IA or IB, columns 5 or 7, line 6, is increased, preferably, an increase of the fine chemical threonine between 19% and 56% is conferred.

In case the activity of the *Saccharomyces cerevisiae* protein YKR057W or a ribosomal protein, similar to S21 ribosomal proteins, involved in ribosome biogenesis and translation or its homolog e.g. as indicated in Table IA or IB, columns 5 or 7, line 7, is increased, preferably, in one embodiment the increase of the fine chemical threonine between 34% and 142% is conferred.

In one embodiment, in case the activity of the *Saccharomyces cerevisiae* protein YIL150C or a "protein required for S-phase (DNA synthesis) initiation or completion" or a chromatin binding protein, required for S-phase (DNA synthesis) initiation or completion or its homologs, e.g. a cell division cycle protein e.g. as indicated in Table IA or IB, columns 5 or 7, line 8, is increased, preferably, in one embodiment the increase of the fine chemical threonine between 25% and 319% is conferred.

In case the activity of the *Saccharomyces cerevisiae* protein YNL046W or its homologs, e.g. a probable membrane protein of the endoplasmatic reticulum e.g. as indicated in Table IA or IB, columns 5 or 7, line 9 is increased, preferably, in one embodiment an increase of the fine chemical threonine between 18% and 53% is conferred.

In one embodiment, in case the activity of the *Saccharomyces cerevisiae* protein YNL120C or its homologs, e.g. as indicated in Table IA or IB, Columns 5 or 7, line 10, is increased, preferably, the increase of the fine chemical threonine of 44% is conferred.

In one embodiment, in case the activity of the *Escherichia coli* K12 protein b0186 or a lysine decarboxylases or its homologs, e.g. as indicated in Table IA or IB, columns 5 or 7, line 11, is increased, preferably, the increase of the fine chemical threonine between 49% and 228% is conferred.

In one embodiment, in case the activity of the *Escherichia coli* K12 protein b0730 or a protein with the activity defined as transcriptional regulator of succinylCoA synthetase operon or its homologs, e.g. as indicated in Table IA or IB, columns 5 or 7, line 12, is increased, preferably, in one embodiment an increase of the fine chemical threonine between 53% and 177% is conferred.

In case the activity of the *Escherichia coli* K12 protein b1829 or its homologs is increased, e.g. the activity of a protease is increased, preferably, the activity of a heat shock protein is increased, more preferred the activity of a htpX protein or its homolog e.g. as indicated in Table IA or IB, columns 5 or 7, line 13, is increased preferably, in one embodiment the increase of the fine chemical threonine between 17% and 114% is conferred.

In case the activity of the *Escherichia coli* K12 protein b2170 or a sugar efflux transporter or its homologs e.g. as indicated in Table IA or IB, columns 5 or 7, line 14, is increased, preferably, in one embodiment the increase of the fine chemical threonine between 35% and 79% is conferred.

In case the activity of the *Escherichia coli* K12 protein b0019 or a protein for the transport of cations or its homologs, e.g. a $Na^+/H^+$ antiporter, e.g. as indicated in Table IA or IB, columns 5 or 7, line 15, is increased, preferably, in one embodiment the increase of the fine chemical threonine between 24% and 44% is conferred.

In one embodiment, in case the activity of the *Escherichia coli* K12 protein b0464 or a protein with the activity defined as transcriptional repressor for multidrug efflux pump (TetR/AcrR family) or its homologs, e.g. as indicated in Table IA or IB, columns 5 or 7, line 339, is increased, preferably, in one embodiment an increase of the fine chemical threonine between 23% and 43% is conferred.

In one embodiment, in case the activity of the *Escherichia coli* K12 protein b1360 or a protein with the activity defined as putative DNA replication protein or its homologs, e.g. as indicated in Table IA or IB, columns 5 or 7, line 340, is increased, preferably, in one embodiment an increase of the fine chemical threonine between 16% and 38% is conferred.

In one embodiment, in case the activity of the *Escherichia coli* K12 protein b1738 or a protein with the activity defined as PEP-dependent phosphotransferase or its homologs, e.g. as indicated in Table IA or IB, columns 5 or 7, line 341, is increased, preferably, in one embodiment an increase of the fine chemical threonine between 27% and 361% is conferred.

In one embodiment, in case the activity of the *Escherichia coli* K12 protein b1830 or a protein with the activity defined as carboxy-terminal protease for penicillin-binding protein 4 or its homologs, e.g. as indicated in Table IA or IB, columns 5 or 7, line 342, is increased, preferably, in one embodiment an increase of the fine chemical threonine between 24% and 43% is conferred.

In one embodiment, in case the activity of the *Escherichia coli* K12 protein b1896 or a protein with the activity defined as trehalose-6-phosphate synthase or its homologs, e.g. e.g. as indicated in Table IA or IB, columns 5 or 7, line 343, is increased, preferably, in one embodiment an increase of the fine chemical threonine between 46% and 108% is conferred.

In one embodiment, in case the activity of the *Escherichia coli* K12 protein b2414 or a protein with the activity defined as subunit of cysteine synthase A and O-acetylserine sulfhydrolase A, PLP-dependent enzyme or its homologs, e.g. as indicated in Table IA or IB, columns 5 or 7, line 345, is increased, preferably, in one embodiment an increase of the fine chemical threonine between 24% and 46% is conferred.

In one embodiment, in case the activity of the *Escherichia coli* K12 protein b2552 or a protein with the activity defined as dihydropteridine reductase (nitric oxide dioxygenase) or its homologs, e.g. as indicated in Table IA or IB, columns 5 or 7, line 346, is increased, preferably, in one embodiment an increase of the fine chemical threonine between 17% and 37% is conferred.

In one embodiment, in case the activity of the *Escherichia coli* K12 protein b4004 or a protein with the activity defined as transcriptional regulatory protein or its homologs, e.g. as indicated in Table IA or IB, columns 5 or 7, line 354, is increased, preferably, in one embodiment an increase of the fine chemical threonine between 17% and 37% is conferred.

In one embodiment, in case the activity of the *Escherichia coli* K12 protein b2664 or a protein with the activity defined as putative transcriptional repressor with DNA-binding Winged helix domain (GntR familiy) or its homologs, e.g. as indicated in Table IA or IB, columns 5 or 7, line 347, is increased, preferably, in one embodiment an increase of the fine chemical threonine between 29% and 284% is conferred.

In one embodiment, in case the activity of the *Escherichia coli* K12 protein b3074 or a protein with the activity defined as putative tRNA synthetase or its homologs, e.g. as indicated in Table IA or IB, columns 5 or 7, line 348, is increased, preferably, in one embodiment an increase of the fine chemical threonine between 31% and 59% is conferred.

In one embodiment, in case the activity of the *Escherichia coli* K12 protein b2270 or its homologs, e.g. as indicated in Table IA or IB, columns 5 or 7, line 344, is increased, preferably, in one embodiment an increase of the fine chemical threonine between 31% and 59% is conferred.

In one embodiment, in case the activity of the *Escherichia coli* K12 protein b3160 or a protein with the activity defined as putative monooxygenase with luciferase-like ATPase activity or its homologs, e.g. as indicated in Table IA or IB, columns 5 or 7, line 349, is increased, preferably, in one embodiment an increase of the fine chemical threonine between 25% and 56% is conferred.

In one embodiment, in case the activity of the *Escherichia coli* K12 protein b3231 or a protein with the activity defined as 50S ribosomal subunit protein L13 or its homologs, e.g. as indicated in Table IA or IB, columns 5 or 7, line 350, is increased, preferably, in one embodiment an increase of the fine chemical threonine between 17% and 32% is conferred.

In one embodiment, in case the activity of the *Escherichia coli* K12 protein b3462 or a protein with the activity defined as integral membrane cell division protein or its homologs, e.g. as indicated in Table IA or IB, columns 5 or 7, line 351, is increased, preferably, in one embodiment an increase of the fine chemical threonine between 18% and 51% is conferred.

In one embodiment, in case the activity of the *Escherichia coli* K12 protein b3791 or a protein with the activity defined as transaminase involved in lipopolysaccharide biosynthesis or its homologs, e.g. as indicated in Table IA or IB, columns 5 or 7, line 352, is increased, preferably, in one embodiment an increase of the fine chemical threonine between 38% and 44% is conferred.

In one embodiment, in case the activity of the *Escherichia coli* K12 protein b3966 or a protein with the activity defined as outer membrane porin or its homologs, e.g. as indicated in Table IA or IB, columns 5 or 7, line 353, is increased, preferably, in one embodiment an increase of the fine chemical threonine between 19% and 47% is conferred.

In case the activity of the *Saccharomyces cerevisiae* protein YOR245C or a protein with the activity defined as acyl-CoA: diacylglycerol acyltransferase or its homologs, e.g. as indicated in Table IA or IB, columns 5 or 7, line 355, is increased, preferably, in one embodment an increase of the fine chemical threonine between 18% and 81% is conferred.

In one embodiment, in case the activity of the *Saccharomyces* cerevisiae protein YFL050C or its homologs, e.g. di-trivalent inorganic cation transporter, is increased, preferably, an increase of the fine chemical threonine and of alanine is conferred.

In one embodiment, in case the activity of the *Saccharomyces* cerevisiae protein YKR057W or its homologs, e.g. an ribosomal protein, similar to S21 ribosomal proteins, involved in ribosome biogenesis and translation is increased, preferably, an increase of the fine chemical threonine and of arginine, is conferred.

In one embodiment, in case the activity of the *Saccharomyces* cerevisiae protein YIL150C or its homologs, e.g. "a chromatin binding protein, required for S-phase (DNA synthesis) initiation or completion" or its homologs, is increased, preferably, an increase of the fine chemical threonine and of fumaric acid is conferred.

In case the activity of the *Escherichia coli* K12 protein b0186 or its homologs, e.g. a lysine decarboxylases or its homologs, is increased preferably, an increase of the fine chemical threonine and of methionine is conferred.

In one embodiment, in case the activity of the *Escherichia coli* K12 protein b0730 or its homologs, e.g. a protein with the activity defined as transcriptional regulator of succinylCoA synthetase operon and fatty acyl response regulator or its homologs is increased preferably an increase of the fine chemical threonine and of beta-carotene is conferred.

In one embodiment, in case the activity of the *Escherichia coli* K12 protein b1829 or its homologs is increased, e.g. the activity of a protease is increased, preferably, the activity of a heat shock protein is increased, more preferred the activity of a htpX protein or its homolog is increased preferably in an increase of the fine chemical threonine and of C18:0 is conferred.

In one embodiment, in case the activity of the *Escherichia coli* K12 protein b2170 or its homologs is increased, e.g. the activity of a sugar efflux transporter B is increased, preferably an increase of the fine chemical threonine and of isopentenyl pyrophosphate is conferred.

In one embodiment, in case the activity of the *Escherichia coli* K12 protein b0019 or its homologs, e.g. a protein for the transport of cations or its homologs, e.g. a Na+/H+ antiporter, is increased, preferably an increase of the fine chemical threonine and of β-sitosterol is conferred.

In this context, the respective fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The respective fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the respective fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of the fine chemical preferably has the structure of the polypeptide described herein, in particular of a polypeptides comprising a consensus sequence as indicated in Table IV, column 7, line 6 to 15, 339 to 355 or of a polypeptide as indicated in Table IIA or IIB, columns 5 or 7, line 6 to 15, 339 to 355 or the functional homologs thereof as described herein, or is encoded by the nucleic acid molecule characterized herein or the nucleic acid molecule according to the invention, for example by a nucleic acid molecule as indicated in Table IA or IB, columns 5 or 7, line 6 to 15, 339 to 355 or its herein described functional homologs and has the herein mentioned activity.

For the purposes of the present invention, the term "threonine" and "L-threonine" also encompass the corresponding salts, such as, for example, threonine hydrochloride or threonine sulfate. Preferably the term threonine is intended to encompass the term L-threonine.

Owing to the biological activity of the proteins which are used in the process according to the invention and which are encoded by nucleic acid molecules according to the invention, it is possible to produce compositions comprising the respective fine chemical, i.e. an increased amount of the free chemical free or bound, e.g. fine chemical compositions. Depending on the choice of the organism used for the process according to the present invention, for example a microorganism or a plant, compositions or mixtures of various fine chemicals, e.g. comprising further distinct amino acids, fatty acids, vitamins, hormones, sugars, lipids, etc. can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps (a) stabilizing a protein conferring the increased expression of a protein encoded by the nucleic acid molecule of the invention or of the polypeptide of the invention, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355, having herein-mentioned the fine chemical-increasing activity;

(b) stabilizing a mRNA conferring the increased expression of a protein encoded by the nucleic acid molecule of the invention, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355 or of a mRNA encoding the polypeptide of the present invention having herein-mentioned threonine increasing activity;

(c) increasing the specific activity of a protein conferring the increasd expression of a protein encoded by the nucleic acid molecule of the invention or of the polypeptide of the present invention having herein-mentioned threonine increasing activity, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355, or decreasing the inhibitiory regulation of the polypeptide of the invention;

(d) generating or increasing the expression of an endogenous or artificial transcription factor mediating the expression of a protein conferring the increased expression of a protein encoded by the nucleic acid molecule of the invention or of the polypeptide of the invention having herein-mentioned threonine increasing activity, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355;

(e) stimulating activity of a protein conferring the increased expression of a protein encoded by the nucleic acid molecule of the present invention or a polypeptide of the present invention having herein-mentioned threonine increasing activity, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355 by adding one or more exogenous inducing factors to the organismus or parts thereof;

(f) expressing a transgenic gene encoding a protein conferring the increased expression of a polypeptide encoded by the nucleic acid molecule of the present invention or a polypeptide of the present invention, having herein-mentioned threonine increasing activity, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355;

(g) increasing the copy number of a gene conferring the increased expression of a nucleic acid molecule encoding a polypeptide encoded by the nucleic acid molecule of the invention or the polypeptide of the invention having herein-mentioned threonine increasing activity, e.g. of a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355;

(h) Increasing the expression of the endogenous gene encoding the polypeptide of the invention, e.g. a polypeptide having an activity of a protein as indicated in Table IIA or IIB, column 3, line 6 to 15, 339 to 355 or its homologs activity, e.g. as indicated in Table IIA or IIB, columns 5 or 7, line 6 to 15, 339 to 355 by adding positive expression or removing negative expression elements; e.g. homologous recombination can be used to either introduce positive regulatory elements like for plants the 35S enhancer into the promoter or to remove repressor elements form regulatory regions. Further gene conversion methods can be used to disrupt repressor elements or to enhance to acitivty of positive elements. Positive elements can be randomly introduced in plants by T-DNA or transposon mutagenesis and lines can be identified in which the positive elements have be integrated near to a gene of the invention, the expression of which is thereby enhanced;

(i) Modulating growth conditions of an organism in such a manner, that the expression or activity of the gene encoding the protein of the invention or the protein itself is enhanced for example microorganisms or plants can be grown under a higher temperature regime leading to an enhanced expression of heat shock proteins, e.g. the heat shock protein of the invention, which can lead an enhanced the fine chemical production; and/or (j) selecting of organisms with expecially high activity of the proteins of the invention from natural or from mutagenized resources and breeding them into the target organisms, eg the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring the increase of threonine after increasing the expression or activity of the encoded polypeptide or having the activity of a polypeptide having an activity of a protein as indicated in Table II, column 5, line 6 to 15, 339 to 355 or its homologs activity, e.g. as indicated in Table IIA or IIB, column 7, line 6 to 15, 339 to 355.

In general, the amount of mRNA or polypeptide in a cell or a compartment of a organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention or the polypeptide used in the method of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell, or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, a organ, an organelle etc., is achieved by increasing the endogenous level of the polypeptide of the invention or the polypeptide used in the method of the invention. Accordingly, in an embodiment of the present invention, the present invention relates to a process wherein the gene copy number of a gene encoding the polynucleotide or nucleic acid molecule of the invention or the nucleic acid molecule used in the method of the invention as herein described is increased. Further, the endogenous level of the polypeptide of the invention or the polypeptide used in the method of the invention as described can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others citied therein. Reverse genetic strategies to identify insertions (which eventually carrying the activation elements) near in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as tilling (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, of the polypeptide of the invention, e.g. conferring the increase of the fine chemical after increase of expression or activity can also be increased by introducing a synthetic transcription factor, which binds close to the coding region of an endogenous polypeptide of the invention- or its endogenous homolog-encoding gene and activates its transcription. A chimeric zinc finger protein can be construed, which comprises a specific DNA-binding domain and an activation domain as e.g. the VP16 domain of Herpes Simplex virus. The specific binding domain can bind to the regulatory region of the endogenous protein-coding region. The expression of the chimeric transcription factor in a organism, in particular in a plant, leads to a specific expression of an endogenous polypeptide of the invention, in particular a plant homolog thereof, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It is therefore advantageously to express in an organism a nucleic acid molecule of the invention or the nucleic acid molecule used in the method of the invention or a polypeptide of the invention or the polypeptide used in the method of the invention derived from a evolutionary distantly related organism, as e.g. using a prokaryotic gene in an eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired respective fine chemical(s).

Owing to the introduction of a gene or a plurality of genes conferring the expression of the nucleic acid molecule of the invention or the polypeptide of the invention, for example the nucleic acid construct mentioned below, into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) fine chemicals, in particular amino acids, likewise the fine chemical.

Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids or its precursors, required for the cell's biosynthesis of amino acids may be increased so that the concentration of necessary or relevant precursors, cofactors or intermediates within the cell(s) or within the corresponding storage compartments is increased. Owing to the increased or novel generated activity of the polypeptide of the invention or the polypeptide used in the method of the invention or owing to the increased number of nucleic acid sequences of the invention and/or to the modulation of further genes which are involved in the biosynthesis of the amino acids, e.g. by increasing the activity of enzymes synthesizing precursors or by destroying the activity of one or more genes which are involved in the breakdown of the amino acids, it is possible to increase the yield, production and/or production efficiency of amino acids in the host organism, such as the plants or the microorganisms.

By influencing the metabolism thus, it is possible to produce, in the process according to the invention, further advantageous hydroxy containing compounds. Examples of such compounds are, in addition to threonine, serine, homoserine, phosphohomoserine or hydroxyproline or methionine.

Accordingly, in one embodiment, the process according to the invention relates to a process which comprises:
(a) providing a non-human organism, preferably a microorganism, a non-human animal, a plant or animal cell, a plant or animal tissue or a plant;
(b) increasing an activity of a polypeptide of the invention or a homolog thereof, e.g. as indicated in Table IIA or IIB, columns 5 or 7, line 6 to 15, 339 to 355 or of a polypeptide being encoded by the nucleic acid molecule of the present invention and described below, e.g. conferring an increase of the fine chemical in the organism, preferably in a microorganism, a non-human animal, a plant or animal cell, a plant or animal tissue or a plant,
(c) growing the organism, preferably a microorganism, a non-human animal, a plant or animal cell, a plant or animal tissue or a plant under conditions which permit the production of the fine chemical in the organism, preferably the microorganism, the plant cell, the plant tissue or the plant; and
(d) if desired, revovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the fine chemical but as option it is also possible to produce, recover and, if desired isolate, other free or/and bound amino acids, in particular lysine. Galili et al., Transgenic Res., 200, 9, 2, 137-144 describes that the heterologous expression of a bacterial gene for the amino acid biosynthesis confers the increase of free as well as of protein-bound amino acids.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the respective fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the respective fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae Tuberculariaceae, Adelotheciaceae, Dinophyceae, Ditrichaceae or Prasinophyceae, or a prokaryotic organism, for example a bacterium or blue alga, in particular a bacterium from the families Actinomycetaceae, Bacillaceae, Brevibacteriaceae, Corynebacteriaceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The microorganisms or the recovered, and if desired isolated, respective fine chemical can then be processed further directly into foodstuffs or animal feeds or for other applications, for example according to the disclosures made in EP-B-0 533 039 or EP-A-0 615 693, which are expressly incorporated herein by reference. The fermentation broth or fermentation products can be purified in the customary manner by extraction and precipitation or via ion exchangers and other methods known to the person skilled in the art and described herein below. Products of these different work-up procedures are amino acids or amino acid compositions which still comprise fermentation broth and cell components in different amounts, advantageously in the range of from 0 to 99% by weight, preferably below 80% by weight, especially preferably between below 50% by weight.

Preferred microorganisms are selected from the group consisting of Chaetomiaceae such as the genera *Chaetomium* e.g. the species *Chaetomidium fimeti*; Choanephoraceae such as the genera *Blakeslea, Choanephora* e.g. the species *Blakeslea trispora, Choanephora cucurbitarum* or *Choanephora infundibulifera* var. *cucurbitarum*; Cryptococcaceae such as the genera *Candida, Crytococcus, Rhodotorula, Torulopsis* e.g. the species *Candida albicans, Candida albomarginata, Candida antarctica, Candida bacarum, Candida bogoriensis, Candida boidinii, Candida bovina, Candida brumptii, Candida cacaoi, Candida cariosilignicola, Candida catenulata, Candida chalmersii, Candida ciferrii, Candida cylindracea, Candida edax, Candida ernobii, Candida famata, Candida freyschussii, Candida friedrichii, Candida glabrata, Candida guiffiermondii, Candida haemulonii, Candida humicola, Candida inconspicua, Candida ingens, Candida intermedia, Candida kefyr, Candida krusei, Candida lactiscondensi, Candida lambica, Candida lipolytica, Candida lusitaniae, Candida macedoniensis, Candida magnoliae, Candida membranaefaciens, Candida mesenterica, Candida multigemmis, Candida mycoderma, Candida nemodendra, Candida nitratophila, Candida norvegensis, Candida norvegica, Candida parapsilosis, Candida pelliculosa, Candida peltata, Candida pini, Candida pseudotropicalis, Candida pulcherrima, Candida punicea, Candida pustula, Candida ravautii, Candida reukaufii, Candida rugosa, Candida sake, Candida silvicola, Candida solani, Candida* sp., *Candida spandovensis, Candida succiphila, Candida tropicalis, Candida utilis, Candida valida, Candida versatilis, Candida vini, Candida zeylanoides, Cryptococcus albidus, Cryptococcus curvatus, Cryptococcus flavus, Cryptococcus humicola, Cryptococcus hungaricus, Cryptococcus kuetzingii, Cryptococcus laurentii, Cryptococcus macerans, Cryptococcus neoformans, Cryptococcus terreus, Cryptococcus uniguttulatus, Rhodotorula acheniorum, Rhodotorula bacarum, Rhodotorula bogoriensis, Rhodotorula flava, Rhodotorula glutinis, Rhodotorula macerans, Rhodotorula minuta, Rhodotorula mucilaginosa, Rhodotorula pilimanae, Rhodotorula pustula, Rhodotorula rubra, Rhodotorula tokyoensis, Torulopsis colliculosa, Torulopsis dattila* or *Torulopsis neoformans*; Cunninghamellaceae such as the genera *Cunninghamella* e.g. the species *Cunninghamella blakesleeana, Cunninghamella echinulata, Cunninghamella echinulata* var. *elegans, Cunninghamella elegans* or *Cunninghamella homothaffica*; Demetiaceae such as the genera *Alternaria, Bipolaris, Cercospora, Chalara, Cladosporium, Curvularia, Exophilia, Helicosporium, Helminthosporium, Orbimyces, Philalophora, Pithomyces, Spilocaea, Thielaviopsis, Wangiella* e.g. the species *Curvularia affinis, Curvularia clavata, Curvularia fallax, Curvularia inaequalis, Curvularia indica, Curvularia lunata, Curvularia pallescens, Curvularia verruculosa* or *Helminothosporium* sp.; Moniliaceae such as the genera *Arthrobotrys, Aspergillus, Epidermophyton, Geotrichum, Gliocladium, Histoplasma, Microsporum, Monilia, Oedocephalum, Oidium, Penicillium, Trichoderma, Trichophyton, Thrichoteclum, Verticillium* e.g. the species *Aspergillus aculeatus, Aspergillus albus, Aspergillus alliaceus, Aspergillus asperescens, Aspergillus awamori, Aspergillus candidus, Aspergillus carbonarius, Aspergillus carneus, Aspergillus chevalieri, Aspergillus chevalieri* var. *intermedius, Aspergillus clavatus, Aspergillus ficuum, Aspergillus flavipes, Aspergillus flavus, Aspergillus foetidus, Aspergillus fumigatus, Aspergillus giganteus, Aspergillus humicola, Aspergillus intermedius, Aspergillus japonicus, Aspergillus nidulans, Aspergillus niger, Aspergillus niveus, Aspergillus ochraceus, Aspergillus oryzae, Aspergillus ostianus, Aspergillus parasiticus, Aspergillus parasiticus* var. *globosus, Aspergillus penicillioides, Aspergillus phoenicis, Aspergillus rugulosus, Aspergillus sclerotiorum, Aspergillus sojae* var. *gymnosardae, Aspergillus sydowi, Aspergillus tamarii, Aspergillus terreus, Aspergillus terricola, Aspergillus toxicarius, Aspergillus unguis, Aspergillus ustus, Aspergillus versicolor, Aspergillus vitricolae, Aspergillus wentii, •Penicillium adametzi, •Penicillium albicans, Penicillium arabicum, Penicillium arenicola, Penicillium argillaceum, Penicillium arvense, Penicillium asperosporum, •Penicillium aurantiogriseum, •Penicillium avellaneum, •Penicillium baarnense, •Penicillium baciffisporum, •Penicillium brasilianum, •Penicillium brevicompactum, •Penicillium camemberti, •Penicillium canadense, •Penicillium canescens, •Penicillium caperatum, •Penicillium capsulatum, •Penicillium caseicolum, •Penicillium chrysogenum, •Penicillium citreonigrum, •Penicillium citrinum, •Penicillium claviforme, •Penicillium commune, •Penicillium corylophilum, •Penicillium corymbiferum, •Penicillium crustosum, •Penicillium cyclopium, •Penicillium daleae, •Penicillium decumbens, •Penicillium dierckxii, •Penicillium digitatum, •Penicillium digitatum* var. *latum, •Penicillium divaricatum, •Penicillium diversum, •Penicillium duclauxii, •Penicillium echinosporum, •Penicillium expansum, •Penicillium fellutanum, •Penicillium frequentans, •Penicillium funiculosum, •Penicillium glabrum, •Penicillium gladioli, •Penicillium griseofulvum, •Penicillium hirsutum, •Penicillium hispanicum, •Penicillium islandicum, •Penicillium italicum, •Penicillium italicum* var. *avellaneum, •Penicillium janczewskii, •Penicillium janthinellum, •Penicillium japonicum, •Penicillium lavendulum, •Penicillium lilacinum, •Penicillium lividum, •Penicillium martensii, •Penicillium megasporum, •Penicillium miczynskii, •Penicillium nalgiovense, •Penicillium nigricans, •Penicillium notatum, •Penicillium ochrochloron, •Penicillium odoratum, •Penicillium oxalicum, •Penicillium paraherquei, •Penicillium patulum, •Penicillium pinophilum, •Penicillium piscarium, •Penicillium pseudostromaticum, •Penicillium puberulum, •Penicillium purpurogenum, •Penicillium raciborskii, •Penicillium roqueforti, •Penicillium rotundum, •Penicillium rubrum, •Penicillium sacculum, •Penicillium simplicissimum, Penicillium* sp., *Penicillium spinulosum, Penicillium steckii, Penicillium stoloniferum, Penicillium striatisporum, Penicillium striatum, Penicillium tardum, Penicillium thomii, Penicillium turbatum, Penicillium variabile, Penicillium vermiculatum, Penicillium vermoesenii, Penicillium verrucosum, Penicillium verrucosum* var. *corymbiferum, Penicillium verrucosum* var. *cyclopium, Penicillium verruculosum, Penicillium vinaceum, Penicillium violaceum, Penicillium viridicatum, Penicillium vulpinum, Trichoderma hamatum, Trichoderma harzianum, Trichoderma koningii, Trichoderma longibrachiatum, Trichoderma polysporum, Trichoderma reesei, Trichoderma virens* or *Trichoderma viride*; Mortierellaceae such as the genera *Mortierella* e.g. the species *Mortierella isabeffina, Mortierella polycephala, Mortierella ramanniana, Mortierella vinacea* or *Mortierella zonata*; Mucoraceae such as the genera *Actinomucor, Mucor, Phycomyces, Rhizopus, Zygorhynchus* e.g. the species *Mucor amphibiorum, Mucor circinelloides* f. *circinelloides, Mucor circinelloides* var. *griseocyanus, Mucor flavus, Mucor fuscus, Mucor griseocyanus, Mucor heterosporus, Mucor hiemalis, Mucor hiemalis* f. *hiemalis, Mucor inaequisporus, Mucor indicus, Mucor javanicus, Mucor mucedo, Mucor mucilagineus, Mucor piriformis, Mucor plasmaticus, Mucor*

*plumbeus, Mucor racemosus, Mucor racemosus* f. *racemosus, Mucor racemosus* f. *sphaerosporus, Mucor rouxianus, Mucor rouxii, Mucor sinensis, Mucor* sp., *Mucor spinosus, Mucor tuberculisporus, Mucor variisporus, Mucor variosporus, Mucor wosnessenskii, Phycomyces blakesleeanus, Rhizopus achlamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus* var. *chinensis, Rhizopus microsporus* var. *oligosporus, Rhizopus microsporus* var. *rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici* or *Rhizopus usamii*; Pythiaceae such as the genera *Phytium, Phytophthora* e.g. the species *Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae* var. *parasitica, Phytophthora palmivora, Phytophthora parasitica* or *Phytophthora syringae*; Sacharomycetaceae such as the genera *Hansenula, Pichia, Saccharomyces, Saccharomycodes, Yarrowia* e.g. the species *Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii, Pichia cellobiosa, Pichia ciferrii, Pichia farinosa, Pichia fermentans, Pichia finlandica, Pichia glucozyma, Pichia guiffiermondii, Pichia haplophila, Pichia henricii, Pichia holstii, Pichia jadinii, Pichia lindnerii, Pichia membranaefaciens, Pichia methanolica, Pichia minuta* var. *minuta, Pichia minuta* var. *nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces baffii, Saccharomyces bayanus, Saccharomyces bisporus, Saccharomyces capensis, Saccharomyces carlsbergensis, Saccharomyces cerevisiae, Saccharomyces cerevisiae* var. *effipsoideus, Saccharomyces chevalieri, Saccharomyces delbrueckii, Saccharomyces diastaticus, Saccharomyces drosophilarum, Saccharomyces elegans, Saccharomyces effipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii* or *Yarrowia lipolytica*; Saprolegniaceae such as the genera *Saprolegnia* e.g. the species *Saprolegnia ferax*; Schizosacharomycetaceae such as the genera *Schizosaccharomyces* e.g. the species *Schizosaccharomyces japonicus* var. *japonicus, Schizosaccharomyces japonicus* var. *versatilis, Schizosaccharomyces malidevorans, Schizosaccharomyces octosporus, Schizosaccharomyces pombe* var. *malidevorans* or *Schizosaccharomyces pombe* var. *pombe*; Sodariaceae such as the genera *Neurospora, Sordaria* e.g. the species *Neurospora africana, Neurospora crassa, Neurospora intermedia, Neurospora sitophila, Neurospora tetrasperma, Sordaria fimicola* or *Sordaria macrospora*; Tuberculariaceae such as the genera *Epicoccum, Fusarium, Myrothecium, Sphacelia, Starkeyomyces, Tubercularia* e.g. the species *Fusarium acuminatum, Fusarium anthophilum, Fusarium aquaeductuum, Fusarium aquaeductuum* var. *medium, Fusarium avenaceum, Fusarium buharicum, Fusarium camptoceras, Fusarium cerealis, Fusarium chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusarium equiseti* var. *bullatum, Fusarium eumartii, Fusarium flocciferum, Fusarium fujikuroi, Fusarium graminearum, Fusarium graminum, Fusarium heterosporum, Fusarium incarnatum, Fusarium inflexum, Fusarium javanicum, Fusarium lateritium, Fusarium lateritium* var. *majus, Fusarium longipes, Fusarium melanochlorum, Fusarium merismoides, Fusarium merismoides* var. *chlamydosporale, Fusarium moniliforme, Fusarium moniliforme* var. *anthophilum, Fusarium moniliforme* var. *subglutinans, Fusarium nivale, Fusarium nivale* var. *majus, Fusarium oxysporum, Fusarium oxysporum* f. sp. *aechmeae, Fusarium oxysporum* f. sp. *cepae, Fusarium oxysporum* f. sp. *conglutinans, Fusarium oxysporum* f. sp. *cucumerinum, Fusarium oxysporum* f. sp. *cyclaminis, Fusarium oxysporum* f. sp. *dianthi, Fusarium oxysporum* f. sp. *lycopersici, Fusarium oxysporum* f. sp. *melonis, Fusarium oxysporum* f. sp. *passiflorae, Fusarium oxysporum* f. sp. *pisi, Fusarium oxysporum* f. sp. *tracheiphilum, Fusarium oxysporum* f. sp. *tuberosi, Fusarium oxysporum* f. sp. *tulipae, Fusarium oxysporum* f. sp. *vasinfectum, Fusarium pallidoroseum, Fusarium poae, Fusarium proliferatum, Fusarium proliferatum* var. *minus, Fusarium redolens, Fusarium redolens* f. sp. *dianthi, Fusarium reticulatum, Fusarium roseum, Fusarium sacchari* var. *elongatum, Fusarium sambucinum, Fusarium sambucinum* var. *coeruleum, Fusarium semitectum, Fusarium semitectum* var. *majus, Fusarium solani, Fusarium solani* f. sp. *pisi, Fusarium sporotrichioides, Fusarium sporotrichioides* var. *minus, Fusarium sublunatum, Fusarium succisae, Fusarium sulphureum, Fusarium tabacinum, Fusarium tricinctum, Fusarium udum, Fusarium ventricosum, Fusarium verticillioides, Fusarium xylarioides* or *Fusarium zonatum*; Sporobolomycetaceae such as the genera *Bullera, Sporobolomyces, Itersonilia* e.g. the species *Sporobolomyces holsaticus, Sporobolomyces odorus, Sporobolomyces puniceus, Sporobolomyces salmonicolor, Sporobolomyces singularis* or *Sporobolomyces tsugae*; Adelotheciaceae such as the genera e.g. the species *Physcomitrella patens*; Dinophyceae such as the genera *Crypthecodinium, Phaeodactylum* e.g. the species *Crypthecodinium cohnii* or *Phaeodactylum tricornutum*; Ditrichaceae such as the genera *Ceratodon, Pleuridium, Astomiopsis, Ditrichum, Philibertiella, Ceratodon, Distichium, Skottsbergia* e.g. the species *Ceratodon antarcticus, Ceratodon purpureus, Ceratodon purpureus* ssp. *convolutes* or *Ceratodon purpureus* ssp. *stenocarpus*; Prasinophyceae such as the genera *Nephroselmis, Prasinococcus, Scherffelia, Tetraselmis, Mantoniella, Ostreococcus* e.g. the species *Nephroselmis olivacea, Prasinococcus capsulatus, Scherffelia dubia, Tetraselmis chui, Tetraselmis suecica, Mantoniella squamata* or *Ostreococcus*

*tauri*; Actinomycetaceae such as the genera *Actinomyces, Actinobaculum, Arcanobacterium, Mobiluncus* e.g. the species *Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii* subsp. *anitratus, Actinomyces neuii* subsp. *neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii* subsp. *curtisii, Mobiluncus curtisii* subsp. *holmesii* or *Mobiluncus mulieris*; Bacillaceae such as the genera *Amphibacillus, Anoxybacillus, Bacillus, Exiguobacterium, Gracilibacillus, Holobacillus, Saccharococcus, Salibacillus, Virgibacillus* e.g. the species *Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius, Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borstelensis, Bacillus brevis, Bacillus carboniphilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus* subsp. *fusiformis, Bacillus galactophilus, Bacillus globisporus, Bacillus globisporus* subsp. *marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquariensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis* subsp. *spizizenii, Bacillus subtilis* subsp. *subtilis, Bacillus thermantarcticus, Bacillus thermoaerophilus, Bacillus thermoamylovorans, Bacillus thermoantarcticus, Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetylicum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus truepefi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii* or *Virgibacillus salexigens*, Brevibacteriaceae such as the genera *Brevibacterium* e.g. the species *Brevibacterium acetylicum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum* or *Brevibacterium vitaeruminis*; Corynebacteriaceae such as the genera *Corynebacterium* e.g. the species *Corynebacterium accolens, Corynebacterium afermentans* subsp. *afermentans, Corynebacterium afermentans* subsp. *lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium ilicis, Corynebacterium imitans, Corynebacterium insidiosum, Corynebacterium iranicum, Corynebacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacte-* rium michiganense subsp. tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis or Corynebacterium xerosis; Enterobacteriacae such as the genera Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingella, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia and Yokenella e.g. the species Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izandii, Buttiauxella noackiae, Buttiauxella warmboldiae, Cedecea davisae, Cedecea lapagei, Cedecea neteri, Citrobacter amalonaticus, Citrobacter diversus, Citrobacter freundii, Citrobacter genomospecies, Citrobacter gillenii, Citrobacter intermedium, Citrobacter koseri, Citrobacter murliniae, Citrobacter sp., Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora subsp. atroseptica, Erwinia carotovora subsp. betavasculorum, Erwinia carotovora subsp. odorifera, Erwinia carotovora subsp. wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxylata, Escherichia anindolica, Escherichia aurescens, Escherichia blattae, Escherichia coli, Escherichia coli var. communion, Escherichia coli-mutabile, Escherichia fergusonii, Escherichia hermannii, Escherichia sp., Escherichia vulneris, Ewingella americana, Hafnia alvei, Klebsiella aerogenes, Klebsiella edwardsii subsp. atlantae, Klebsiella ornithinolytica, Klebsiella oxytoca, Klebsiella planticola, Klebsiella pneumoniae, Klebsiella pneumoniae subsp. pneumoniae, Klebsiella sp., Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera sp., Leclercia adecarboxylata, Leminorella grimontii, Leminorella richardii, Moellerella wisconsensis, Morganella morganii, Morganella morganii subsp. morganii, Morganella morganii subsp. sibonii, Obesumbaterium proteus, Pantoea agglomerans, Pantoea ananatis, Pantoea citrea, Pantoea dispersa, Pantoea punctata, Pantoea stewartii subsp. stewartii, Pantoea terrea, Pectobacterium atrosepticum, Pectobacterium carotovorum subsp. atrosepticum, Pectobacterium carotovorum subsp. carotovorum, Pectobacterium chrysanthemi, Pectobacterium cypripedii, Photorhabdus asymbiotica, Photorhabdus luminescens, Photorhabdus luminescens subsp. akhurstii, Photorhabdus luminescens subsp. laumondii, Photorhabdus luminescens subsp. luminescens, Photorhabdus sp., Photorhabdus temperata, Plesiomonas shigelloides, Pragia fontium, Proteus hauseri, Proteus ichthyosmius, Proteus inconstans, Proteus mirabilis, Proteus morganii, Proteus myxofaciens, Proteus penneri, Proteus rettgeri, Proteus shigelloides, Proteus vulgaris, Providencia alcalifaciens, Providencia friedericiana, Providencia heimbachae, Providencia rettgeri, Providencia rustigianii, Providencia stuartii, Rahnella aquatilis, Salmonella abony, Salmonella arizonae, Salmonella bongori, Salmonella choleraesuis subsp. arizonae, Salmonella choleraesuis subsp. bongori, Salmonella choleraesuis subsp. chlolereasuis, Salmonella choleraesuis subsp. diarizonae, Salmonella choleraesuis subsp. houtenae, Salmonella choleraesuis subsp. indica, Salmonella choleraesuis subsp. salamae, Salmonella daressalaam, Salmonella enterica subsp. houtenae, Salmonella enterica subsp. salamae, Salmonella enteritidis, Salmonella gallinarum, Salmonella heidelberg, Salmonella panama, Salmonella senftenberg, Salmonella typhimurium, Serratia entomophila, Serratia ficaria, Serratia fonticola, Serratia grimesii, Serratia liquefaciens, Serratia marcescens, Serratia marcescens subsp. marcescens, Serratia marinorubra, Serratia odorifera, Serratia plymouthensis, Serratia plymuthica, Serratia proteamaculans, Serratia proteamaculans subsp. quinovora, Serratia quinivorans, Serratia rubidaea, Shigella boydii, Shigella flexneri, Shigella paradysenteriae, Shigella sonnei, Tatumella ptyseos, Xenorhabdus beddingii, Xenorhabdus bovienii, Xenorhabdus luminescens, Xenorhabdus nematophila, Xenorhabdus nematophila subsp. beddingii, Xenorhabdus nematophila subsp. bovienii, Xenorhabdus nematophila subsp. poinarii or Xenorhabdus poinarii; Gordoniaceae such as the genera Gordonia, Skermania e.g. the species Gordonia aichiensis, Gordonia alkanivorans, Gordonia amarae, Gordonia amicalis, Gordonia bronchialis, Gordonia desulfuricans, Gordonia hirsuta, Gordonia hydrophobica, Gordonia namibiensis, Gordonia nitida, Gordonia paraffinivorans, Gordonia polyisoprenivorans, Gordonia rhizosphera, Gordonia rubripertincta, Gordonia sihwensis, Gordonia sinesedis, Gordonia sputi, Gordonia terrae or Gordonia westfalica; Micrococcaceae such as the genera Micrococcus, Arthrobacter, Kocuria, Nesterenkonia, Renibacterium, Rothia, Stomatococcus e.g. the species Micrococcus agilis, Micrococcus antarcticus, Micrococcus halobius, Micrococcus kristinae, Micrococcus luteus, Micrococcus lylae, Micrococcus nishinomiyaensis, Micrococcus roseus, Micrococcus sedentarius, Micrococcus varians, Arthrobacter agilis, Arthrobacter albus, Arthrobacter atrocyaneus, Arthrobacter aurescens, Arthrobacter chlorophenolicus, Arthrobacter citreus, Arthrobacter creatinolyticus, Arthrobacter crystallopoietes, Arthrobacter cumminsii, Arthrobacter duodecadis, Arthrobacter flavescens, Arthrobacter flavus, Arthrobacter gandavensis, Arthrobacter globiformis, Arthrobacter histidinolovorans, Arthrobacter ilicis, Arthrobacter koreensis, Arthrobacter luteolus, Arthrobacter methylotrophus, Arthrobacter mysorens, Arthrobacter nasiphocae, Arthrobacter nicotianae, Arthrobacter nicotinovorans, Arthrobacter oxydans, Arthrobacter pascens, Arthrobacter picolinophilus, Arthrobacter polychromogenes, Arthrobacter protophormiae, Arthrobacter psychrolactophilus, Arthrobacter radiotolerans, Arthrobacter ramosus, Arthrobacter rhombi, Arthrobacter roseus, Arthrobacter siderocapsulatus, Arthrobacter simplex, Arthrobacter sulfonivorans, Arthrobacter sulfureus, Arthrobacter terregens, Arthrobacter tumescens, Arthrobacter uratoxydans, Arthrobacter ureafaciens, Arthrobacter variabilis, Arthrobacter viscosus, Arthrobacter woluwensis, Kocuria erythromyxa, Kocuria kristinae, Kocuria palustris, Kocuria polaris, Kocuria rhizophila, Kocuria rosea, Kocuria varians, Nesterenkonia halobia, Nesterenkonia lacusekhoensis, Renibacterium salmoninarum, Rothia amarae, Rothia dentocariosa, Rothia mucilaginosa, Rothia nasimurium or Stomatococcus mucilaginosus; Mycobacteriaceae such as the genera Mycobacterium e.g. the species Mycobacterium africanum, Mycobacterium agri, Mycobacterium aichiense, Mycobacterium alvei, Mycobacterium asiaticum, Mycobacterium aurum, Mycobacterium austroafricanum, Mycobacterium bohemicum, Mycobacterium botniense, Mycobacterium brumae, Mycobacterium chelonae subsp. abscessus, Mycobacterium chitae, Mycobacterium chlorophenolicum, Mycobacterium chubuense, Mycobacterium confluentis, Mycobacterium cookii, Mycobacterium diemhoferi, Mycobacterium doricum, Mycobacterium duvalii, Mycobacterium fallax, Mycobacterium farcinogenes, Mycobacterium flavescens, Mycobacterium frederiksbergense, Mycobacterium gadium, Mycobacterium gilvum, Mycobacterium gordonae, Mycobacterium hassiacum, Mycobacterium hibemiae, Mycobacterium hodleri, Mycobacterium holsaticum, Mycobacterium komossense, Mycobacterium lacus, Mycobacterium madagascariense, Mycobacterium mageritense, Mycobacterium montefiorense, Mycobacterium moriokaense, Mycobacterium murale, Mycobacterium neoaurum, Mycobacterium nonchromogenicum, Mycobacterium obuense, Mycobacterium palustre, Mycobacterium parafortuitum, Mycobacterium peregrinum, Mycobacterium phlei, Mycobacterium pinnipedii, Mycobacterium poriferae, Mycobacterium pulveris, Mycobacterium rhodesiae, Mycobacterium shottsii, Mycobacterium sphagni, Mycobacterium terrae, Mycobacterium the rmoresistibile, Mycobacterium tokaiense, Mycobacterium trivia/e, Mycobacterium tusciae or Mycobacterium vanbaalenii; Nocardiaceae such as the genera Nocardia, Rhodococcus e.g. the species Nocardia abscessus, Nocardia africana, Nocardia amarae, Nocardia asteroides, Nocardia autotrophica, Nocardia beijingensis, Nocardia brasiliensis, Nocardia brevicatena, Nocardia caishijiensis, Nocardia calcarea, Nocardia carnea, Nocardia cellulans, Nocardia cerradoensis, Nocardia coeliaca, Nocardia corynebacterioides, Nocardia crassostreae, Nocardia cummidelens, Nocardia cyriacigeorgica, Nocardia farcinica, Nocardia flavorosea, Nocardia fluminea, Nocardia globerula, Nocardia hydrocarbonoxydans, Nocardia ignorata, Nocardia mediterranei, Nocardia nova, Nocardia orientalis, Nocardia otitidis-caviarum, Nocardia otitidiscaviarum, Nocardia paucivorans, Nocardia petroleophila, Nocardia pinensis, Nocardia pseudobrasiliensis, Nocardia pseudovaccinii, Nocardia purls, Nocardia restricta, Nocardia rugosa, Nocardia salmonicida, Nocardia saturnea, Nocardia seriolae, Nocardia soli, Nocardia sulphurea, Nocardia transvalensis, Nocardia uniformis, Nocardia vaccinii, Nocardia veterana or Nocardia vinacea; Pseudomonaceae such as the genera Azomonas, Azotobacter, Cellvibrio, Chryseomonas, Flaviomonas, Lampropedia, Mesophilobacter, Moroccocus, Oligella, Pseudomonas, Rhizobacter, Rugamonas, Serpens, Thermoleophilum, Xylophilus e.g. the species Azomonas agilis, Azomonas insignis, Azomonas macrocytogenes, Azotobacter agilis, Azotobacter agilis subsp. armeniae, Azotobacter armeniacus, Azotobacter beijerinckii, Azotobacter chroococcum, Azotobacter indicum, Azotobacter macrocytogenes, Azotobacter miscellum, Azotobacter nigricans subsp. nigricans, Azotobacter paspali, Azotobacter salinestris, Azotobacter sp., Azotobacter vinelandii, Flavimonas oryzihabitans, Mesophilobacter marinus, Oligella urethralis, Pseudomonas acidovorans, Pseudomonas aeruginosa, Pseudomonas agarici, Pseudomonas alcaligenes, Pseudomonas aminovorans, Pseudomonas amygdali, Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocoffigans, Pseudomonas balearica, Pseudomonas barkeri, Pseudomonas bathycetes, Pseudomonas beijerinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chioritidismutans, Pseudomonas chlororaphis, Pseudomonas cichorii, Pseudomonas citronellolis, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes subsp. konjaci, Pseudomonas pseudoalcaligenes subsp. pseudoalcaligenes, Pseudomonas pseudoflava, Pseudomonas putida, Pseudomonas putida var. naraensis, Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbicans, Pseudomonas ruhlandii, Pseudomonas saccharophila,

*Pseudomonas savastanoi, Pseudomonas savastanoi* pvar. *glycinea, Pseudomonas savastanoi* pvar. *phaseolicola, Pseudomonas solanacearum, Pseudomonas* sp., *Pseudomonas spinosa, Pseudomonas stanieri, Pseudomonas stutzeri, Pseudomonas syringae, Pseudomonas syringae* pvar. *aptata, Pseudomonas syringae* pvar. *atrofaciens, Pseudomonas syringae* pvar. *coronafaciens, Pseudomonas syringae* pvar. *delphinii, Pseudomonas syringae* pvar. *glycinea, Pseudomonas syringae* pvar. *helianthi, Pseudomonas syringae* pvar. *lachrymans, Pseudomonas syringae* pvar. *lapsa, Pseudomonas syringae* pvar. *morsprunorum, Pseudomonas syringae* pvar. *phaseolicola, Pseudomonas syringae* pvar. *primulae, Pseudomonas syringae* pvar. *syringae, Pseudomonas syringae* pvar. *tabaci, Pseudomonas syringae* pvar. *tomato, Pseudomonas syringae* subsp. *glycinea, Pseudomonas syringae* subsp. *savastanoi, Pseudomonas syringae* subsp. *syringae, Pseudomonas syzygii, Pseudomonas tabaci, Pseudomonas taeniospiralis, Pseudomonas testosteroni, Pseudomonas thermocarboxydovorans, Pseudomonas thermotolerans, Pseudomonas thivervalensis, Pseudomonas tomato, Pseudomonas trivialis, Pseudomonas veronii, Pseudomonas vesicularis, Pseudomonas viridiflava, Pseudomonas viscogena, Pseudomonas woodsii, Rhizobacter dauci, Rhizobacter daucus* or *Xylophilus ampelinus*; Rhizobiaceae such as the genera *Agrobacterium, Carbophilus, Chelatobacter, Ensifer, Rhizobium, Sinorhizobium* e.g. the species *Agrobacterium atlanticum, Agrobacterium ferrugineum, Agrobacterium gelatinovorum, Agrobacterium larrymoorei, Agrobacterium meteori, Agrobacterium radiobacter, Agrobacterium rhizogenes, Agrobacterium rubi, Agrobacterium stellulatum, Agrobacterium tumefaciens, Agrobacterium vitis, Carbophilus carboxidus, Chelatobacter heintzii, Ensifer adhaerens, Ensifer arboris, Ensifer fredii, Ensifer kostiensis, Ensifer kummerowiae, Ensifer medicae, Ensifer meliloti, Ensifer saheli, Ensifer terangae, Ensifer xinjiangensis, Rhizobium ciceri Rhizobium etli, Rhizobium fredii, Rhizobium galegae, Rhizobium gafficum, Rhizobium giardinii, Rhizobium hainanense, Rhizobium huakuii, Rhizobium huautlense, Rhizobium indigoferae, Rhizobium japonicum, Rhizobium leguminosarum, Rhizobium loessense, Rhizobium loti, Rhizobium lupini, Rhizobium mediterraneum, Rhizobium meliloti, Rhizobium mongolense, Rhizobium phaseoli, Rhizobium radiobacter, Rhizobium rhizogenes, Rhizobium rubi, Rhizobium sullae, Rhizobium tianshanense, Rhizobium trifolii, Rhizobium tropici, Rhizobium undicola, Rhizobium vitis, Sinorhizobium adhaerens, Sinorhizobium arboris, Sinorhizobium fredii, Sinorhizobium kostiense, Sinorhizobium kummerowiae, Sinorhizobium medicae, Sinorhizobium meliloti, Sinorhizobium morelense, Sinorhizobium saheli* or *Sinorhizobium xinjiangense*; Streptomycetaceae such as the genera *Kitasatosprora, Streptomyces, Streptoverticillium* e.g. the species *Streptomyces abikoensis, Streptomyces aburaviensis, Streptomyces achromogenes* subsp. *achromogenes, Streptomyces achromogenes* subsp. *rubradiris, Streptomyces acidiscabies, Streptomyces acrimycini, Streptomyces aculeolatus, Streptomyces afghaniensis, Streptomyces alanosinicus, Streptomyces albaduncus, Streptomyces albiaxialis, Streptomyces albidochromogenes, Streptomyces albidoflavus, Streptomyces albireticuli, Streptomyces albofaciens, Streptomyces alboflavus, Streptomyces albogriseolus, Streptomyces albolongus, Streptomyces alboniger, Streptomyces albospinus, Streptomyces albosporeus* subsp. *albosporeus, Streptomyces albosporeus* subsp. *labilomyceticus, Streptomyces alboverticillatus, Streptomyces albovinaceus, Streptomyces alboviridis, Streptomyces albulus, Streptomyces albus* subsp. *albus, Streptomyces albus* subsp. *pathocidicus, Streptomyces almquistii, Streptomyces althioticus, Streptomyces amakusaensis, Streptomyces ambofaciens, Streptomyces aminophilus, Streptomyces anandii, Streptomyces anthocyanicus, Streptomyces antibioticus, Streptomyces antimycoticus, Streptomyces anulatus, Streptomyces arabicus, Streptomyces ardus, Streptomyces arenae, Streptomyces argenteolus, Streptomyces armeniacus, Streptomyces asiaticus, Streptomyces asterosporus, Streptomyces atratus, Streptomyces atroaurantiacus, Streptomyces atroolivaceus, Streptomyces atrovirens, Streptomyces aurantiacus, Streptomyces aurantiogriseus, Streptomyces aureocirculatus, Streptomyces aureofaciens, Streptomyces aureorectus, Streptomyces aureoversilis, Streptomyces aureoverticillatus, Streptomyces aureus, Streptomyces avellaneus, Streptomyces avermectinius, Streptomyces avermitilis, Streptomyces avidinii, Streptomyces azaticus, Streptomyces azureus, Streptomyces baarnensis, Streptomyces bacillaris, Streptomyces badius, Streptomyces baldaccii, Streptomyces bambergiensis, Streptomyces beijiangensis, Streptomyces bellus, Streptomyces bikiniensis, Streptomyces biverticillatus, Streptomyces blastmyceticus, Streptomyces bluensis, Streptomyces bobili, Streptomyces bottropensis, Streptomyces brasiliensis, Streptomyces bungoensis, Streptomyces cacaoi* subsp. *asoensis, Streptomyces cacaoi* subsp. *cacaoi, Streptomyces caelestis, Streptomyces caeruleus, Streptomyces californicus, Streptomyces calvus, Streptomyces canaries, Streptomyces candidus, Streptomyces canescens, Streptomyces cangkringensis, Streptomyces caniferus, Streptomyces canus, Streptomyces capillispiralis, Streptomyces capoamus, Streptomyces carpaticus, Streptomyces carpinensis, Streptomyces catenulae, Streptomyces caviscabies, Streptomyces cavourensis* subsp. *cavourensis, Streptomyces cavourensis* subsp. *washingtonensis, Streptomyces cellostaticus, Streptomyces celluloflavus, Streptomyces cellulolyticus, Streptomyces cellulosae, Streptomyces champavatii, Streptomyces chartreuses, Streptomyces chattanoogensis, Streptomyces chibaensis, Streptomyces chrestomyceticus, Streptomyces chromofuscus, Streptomyces chryseus, Streptomyces chrysomallus* subsp. *chrysomallus, Streptomyces chrysomallus* subsp. *fumigatus, Streptomyces cinereorectus, Streptomyces cinereoruber* subsp. *cinereoruber, Streptomyces cinereoruber* subsp. *fructofermentans, Streptomyces cinereospinus, Streptomyces cinereus, Streptomyces cinerochromogenes, Streptomyces cinnabarinus, Streptomyces cinnamonensis, Streptomyces cinnamoneus, Streptomyces cinnamoneus* subsp. *albosporus, Streptomyces cinnamoneus* subsp. *cinnamoneus, Streptomyces cinnamoneus* subsp. *lanosus, Streptomyces cinnamoneus* subsp. *sparsus, Streptomyces cirratus, Streptomyces ciscaucasicus, Streptomyces citreofluorescens, Streptomyces clavifer, Streptomyces clavuligerus, Streptomyces cochleatus, Streptomyces coelescens, Streptomyces coelicoflavus, Streptomyces coelicolor, Streptomyces coeruleoflavus, Streptomyces coeruleofuscus, Streptomyces coeruleoprunus, Streptomyces coeruleorubidus, Streptomyces coerulescens, Streptomyces collinus, Streptomyces colombiensis, Streptomyces corchorusii, Streptomyces costaricanus, Streptomyces cremeus, Streptomyces crystallinus, Streptomyces curacoi, Streptomyces cuspidosporus, Streptomyces cyaneofuscatus, Streptomyces cyaneus, Streptomyces cyanoalbus, Streptomyces cystargineus, Streptomyces daghestanicus, Streptomyces diastaticus* subsp. *ardesiacus, Streptomyces diastaticus* subsp. *diastaticus, Streptomyces diastatochromogenes, Streptomyces distallicus, Streptomyces djakartensis, Streptomyces durhamensis, Streptomyces echinatus, Streptomyces echinoruber, Streptomyces ederensis, Streptomyces ehimensis, Streptomyces endus, Streptomyces enissocaesilis, Streptomyces erumpens, Streptomyces erythraeus, Streptomyces erythrogriseus, Streptomyces eurocidicus, Streptomyces* europaeiscabiei, Streptomyces eurythermus, Streptomyces exfoliates, Streptomyces felleus, Streptomyces fervens, Streptomyces fervens subsp. fervens, Streptomyces fervens subsp. melrosporus, Streptomyces filamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flaviscleroticus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatiscleroticus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces Streptomyces glaucescens, Streptomyces glaucosporus, Streptomyces glaucus, Streptomyces globisporus subsp. caucasicus, Streptomyces globisporus subsp. flavofuscus, Streptomyces globisporus subsp. globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocarneus, Streptomyces griseochromogenes, Streptomyces griseoflavus, Streptomyces griseofuscus, Streptomyces griseoincarnatus, Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces griseoverticillatus, Streptomyces griseoviridis, Streptomyces griseus subsp. alpha, Streptomyces griseus subsp. cretosus, Streptomyces griseus subsp. griseus, Streptomyces griseus subsp. solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus subsp. angustmyceticus, Streptomyces hygroscopicus subsp. decoyicus, Streptomyces hygroscopicus subsp. glebosus, Streptomyces hygroscopicus subsp. hygroscopicus, Streptomyces hygroscopicus subsp. ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae subsp. grasserius, Streptomyces lavendulae subsp. lavendulae, Streptomyces lavenduligriseus, Streptomyces lavendulocolor, Streptomyces levis, Streptomyces libani subsp. libani, Streptomyces libani subsp. rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces matensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporeus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli subsp. cellulophilus, Streptomyces olivoreticuli subsp. olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramulosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus subsp. paromomycinus, Streptomyces rimosus subsp. rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, Streptomyces rubiginosohelvolus, Streptomyces rubiginosus, Streptomyces rubrogriseus, Streptomyces rutgersensis subsp. castelarensis, Streptomyces rutgersensis subsp. rutgersensis, Streptomyces salmonis, Streptomyces sampsonii, Streptomyces sanglieri, Streptomyces sannanensis, *Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces the rmodiastaticus, Streptomyces thermogriseus, Streptomyces thermolineatus, Streptomyces thermonitrificans, Streptomyces thermospinosisporus, Streptomyces thermoviolaceus* subsp. *apingens, Streptomyces thermoviolaceus* subsp. *thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vinaceus, Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticillium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium b/astmyceticum, Streptoverticillium cinnamoneum* subsp. *albosporum, Streptomyces cinnamoneus* subsp. *albosporus, Streptoverticillium cinnamoneum* subsp. *cinnamoneum, Streptoverticillium cinnamoneum* subsp. *lanosum, Streptoverticillium cinnamoneum* subsp. *sparsum, Streptoverticillium distafficum, Streptoverticillium ehimense, Streptoverticillium eurocidicum, Streptoverticillium fervens* subsp. *fervens, Streptoverticillium fervens* subsp. *melrosporus, Streptoverticillium flavopersicum, Streptoverticillium griseocarneum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli* subsp. *cellulophilum, Streptoverticillium olivoreticuli* subsp. *olivoreticuli, Streptoverticillium olivoreticulum, Streptoverticillium olivoreticulum* subsp. *cellulophilum, Streptoverticillium olivoverticillatum, Streptoverticillium orinoci, Streptoverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptoverticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum.*

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida boidinii, Candida bombicola, Candida cylindracea, Candida parapsilosis, Candida rugosa, Candida tropicalis, Pichia methanolica* and *Pichia pastoris.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species *laurel Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elaeis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticiffiflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia* [macadamia]; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nic-* otiana attenuata, Nicotiana glauca, Nicotiana langsdorffii, Nicotiana obtusifolia, Nicotiana quadrivalvis, Nicotiana repanda, Nicotiana rustica, Nicotiana sylvestris [tobacco], Solanum tuberosum [potato], Solanum melongena [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can in princible also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana*. Fabaceae such as the genera *Glycine* e.g. the species *Glycine max, Soja hispida* or *Soja max* [soybean] (wobei ich nicht sicher bin, ob es Soja max überhaupt gibt, die heißt eigentlich Glycine max). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum., Lycopersicon pyriforme, Solanum integrifolium* or *Solanum lycopersicum* [tomato].

All abovementioned organisms can in princible also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either (a) a nucleic acid sequence as indicated in Table IA or IB, columns 5 or 7, lines 6 to 15, 339 to 355 a derivative thereof, or (b) a genetic regulatory element, for example a promoter, which is functionally linked to the nucleic acid sequence as indicated in Table IA or IB, columns 5 or 7, lines 6 to 15, 339 to 355 or a derivative thereof, or (c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide radicals. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The respective fine chemical, which is synthesized in the organism, in particular the microorganism, the cell, the tissue or the plant, of the invention can be isolated if desired. Depending on the use of the respective fine chemical, different purities resulting from the purification may be advantageous as will be described herein below.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine.

In one embodiment, after an activity of a polypeptide of the present invention has been increased or generated, or after the expression of a nucleic acid molecule or polypeptide according to the invention has been generated or increased, the transgenic plant generated can be grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure respective fine chemical or chemically pure compositions comprising the respective fine chemical may also be produced by the process described above. To this end, the respective fine chemical or the compositions are isolated in the known manner from an organism according to the invention, such as the microorganisms, non-human animal or the plants, and/or their culture medium in which or on which the organisms had been grown. These chemically pure respective fine chemical or said compositions are advantageous for applications in the field of the food industry, the cosmetics industry or the pharmaceutical industry.

Thus, the content of plant components and preferably also further impurities is as low as possible, and the abovementioned respective fine chemical is obtained in as pure form as possible. In these applications, the content of plant components advantageously amounts to less than 10%, preferably 1%, more preferably 0.1%, very especially preferably 0.01% or less.

Accordingly, the respective fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the respective fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found a tissue, more preferred in an organism or in a harvestable part thereof.

In principle, the respective fine chemicals produced can be increased in two ways by the process according to the invention. The pool of free respective fine chemicals, in particular of the free respective fine chemical, and/or the content of protein-bound respective fine chemicals, in particular of the protein-bound respective fine chemical may advantageously be increased.

It may be advantageous to increase the pool of free amino acids in the transgenic organisms by the process according to the invention in order to isolate high amounts of the pure respective fine chemical.

In another preferred embodiment of the invention a combination of the increased expression of the nucleic acid sequence or the protein of the invention together with the transformation of a protein or polypeptid, which functions as a sink for the desired amino acid for example methionine, lysine or threonine in the organism is useful to increase the production of the respective fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670,635). Galili et al., Transgenic Res. 2000 showed, that enhancing the synthesis of threonine by a feed back insensitive aspartate kinase did not lead only to in increase in free threonine but also in protein bound threonine.

In may also be advantageous to increase the content of the protein-bound respective fine chemical.

In a further embodiment, the fine chemical threonine is produced in accordance with the invention and, if desired, is isolated. The production of further amino acids such as methionine, lysine and/or mixtures of amino acid by the process according to the invention is advantageous.

In the case of the fermentation of microorganisms, the abovementioned amino acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamid resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acide. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews MJ, 1997 (Lysine, threonine and methionine biosynthesis. In BK Singh, ed, Plant Amino Acids: Biochemistry and Biotechnology. Dekker, New York, pp 205-225; H Hesse and R Hoefgen. (2003) Molecular aspects of methionine biosynthesis. TIPS 8(259-262.

In a preferred embodiment, the present invention relates to a process for the production of the fine chemical threonine comprising or generating in an organism or a part thereof the expression of at least one nucleic acid molecule comprising a nucleic acid molecule selected from the group consisting of:

(a) nucleic acid molecule encoding, preferably at least the mature form, of a polypeptide having a sequence as indicated in Table IIA or IIB, columns 5 or 7, lines 6 to 15, 339 to 355;

(b) nucleic acid molecule comprising, preferably at least the mature form, of a nucleic acid molecule having a sequence as indicated in Table IA or IB, columns 5 or 7, lines 6 to 15, 339 to 355;

(c) nucleic acid molecule whose sequence can be deduced from a polypeptide sequence encoded by a nucleic acid molecule of (a) or (b) as result of the degeneracy of the genetic code and conferring an increase in the amount of the fine chemical threonine in an organism or a part thereof;

(d) nucleic acid molecule encoding a polypeptide which has at least 50% identity with the amino acid sequence of the polypeptide encoded by the nucleic acid molecule of (a) to (c) and conferring an increase in the amount of the fine chemical threonine in an organism or a part thereof;

(e) nucleic acid molecule which hybidizes with a nucleic acid molecule of (a) to (c) under stringent hybridisation conditions and conferring an increase in the amount of the fine chemical threonine in an organism or a part thereof;

(f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical threonine in an organism or a part thereof;

(g) nucleic acid molecule encoding a fragment or an epitope of a polypeptide which is encoded by one of the nucleic acid molecules of (a) to (e), preferably to (a) to (c) and conferring an increase in the amount of the fine chemical threonine in an organism or a part thereof;

(h) nucleic acid molecule comprising a nucleic acid molecule which is obtained by amplifying nucleic acid molecules from a cDNA library or a genomic library using the primers pairs having a sequence as indicated in Table III, columns 7, lines 6 to 15, 339 to 355, and conferring an increase in the amount of the fine chemical threonine in an organism or a part thereof;

(i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical threonine in an organism or a part thereof;

(j) nucleic acid molecule which encodes a polypeptide comprising the consensus sequence having a sequences as indicated in Table IV, column 7, lines 6 to 15, 339 to 355 and conferring an increase in the amount of the fine chemical threonine in an organism or a part thereof;

(k) nucleic acid molecule comprising one or more of the nucleic acid molecule encoding the amino acid sequence of a polypeptide encoding a domain of a polypeptide indicated in Table IIA or IIB, columns 5 or 7, lines 6 to 15, 339 to 355 and conferring an increase in the amount of the fine chemical threonine in an organism or a part thereof; and (l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical threonine in an organism or a part thereof;

or which comprises a sequence which is complementary thereto.

In one embodiment, the nucleic acid molecule of the invention distinguishes over the sequence indicated in Table IA or IB, columns 5 or 7, lines 6 to 15, 339 to 355 by one or more nucleotides. In one embodiment, the nucleic acid molecule of the present invention does not consist of the sequence shown in indicated in Table IA or IB, columns 5 or 7, lines 6 to 15, 339 to 355. In another embodiment, the nucleic acid molecule does not encode a polypeptide of a sequence indicated in Table IA or IB, columns 5 or 7, lines 6 to 15, 339 to 355.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, The terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as indicated in Table IA or IB, columns 5 or 7, lines 6 to 15, 339 to 355, nucleic acid molecules which are derived from an amino acid sequences as indicated in Table IIA or IIB, columns 5 or 7, lines 6 to 15, 339 to 355 or from polypeptides comprising the consensus sequence as indicated in Table IV, column 7, lines 6 to 15, 339 to 355 or their derivatives or homologues encoding polypeptides with the enzymatic or biological activity of a polypeptide as indicated in Table IIA or IIB, column 3, 5 or 7, lines 6 to 15, 339 to 355 or e.g. conferring a increase of the fine chemical threonine after increasing its expression or activity are advantageously increased in the process according to the invention.

In one embodiment, said sequences are cloned into nucleic acid constructs, either individually or in combination. These nucleic acid constructs enable an optimal synthesis of the respective fine chemical produced in the process according to the invention.

Nucleic acid molecules, which are advantageous for the process according to the invention and which encode polypeptides with an activity of a polypeptide of the invention can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Chemy J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with an activity of a polypeptide as indicated in Table IIa or IIB, column 3, lines 6 to 15, 339 to 355 or having the sequence of a polypeptide as indicated in Table IIA or IIB, columns 5 and 7, lines 6 to 15, 339 to 355 and conferring an increase of the fine chemical threonine.

The nucleic acid sequence(s) used in the process for the production of the respective fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the respective fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the respective fine chemical produced in the process according to the invention. This improved production, or production efficiency, of the respective fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis.*

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species *Saccharomyces cerevisiae* for the production of the respective fine chemical in microorganism.

The skilled worker knows other suitable sources for the production of respective fine chemicals, which present also useful nucleic acid molecule sources. They include in general all prokaryotic or eukaryotic cells, preferably unicellular microorganisms, such as fungi like the genus *Claviceps* or

*Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*.

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

However, it is also possible to use artificial sequences, which differ in one or more bases from the nucleic acid sequences found in organisms, or in one or more amino acid molecules from polypeptide sequences found in organisms, in particular from the polypeptide sequences indicated in Table IIA or IIB, columns 5 or 7, lines 6 to 15, 339 to 355 or the functional homologues thereof as described herein, preferably conferring above-mentioned activity, i.e. conferring a increase of the fine chemical threonine after increasing its activity In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as the pairs indicated in Table III, column 7, lines 6 to 15, 339 to 355 by means of polymerase chain reaction can be generated on the basis of a sequence as indicated in Table IA or IB, columns 5 or 7, lines 6 to 15, 339 to 355 or the sequences derived from sequences as indicated in Table IIA or IIB, columns 5 or 7, lines 6 to 15, 339 to 355.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved region for the polypeptide of the invention are indicated in the alignments shown in the figures. Conserved regions are those, which show a very little variation in the amino acid in one particular position of several homologs from different origin. The consenus sequences indicated in Table IV, column 7, lines 6 to 15, 339 to 355 are derived from said aligments.

Degenerated primers can then be utilized by PCR for the amplification of fragments of novel proteins having abovementioned activity, e.g. conferring the increase of the fine chemical after increasing its expression or activity or further functional homologs of the polypeptide of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hydridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2×SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown herein below:

(1) Hybridization conditions can be selected, for example, from the following conditions:
a) 4×SSC at 65° C.,
b) 6×SSC at 45° C.,
c) 6×SSC, 100 mg/ml denatured fragmented fish sperm DNA at 68° C.,
d) 6×SSC, 0.5% SDS, 100 mg/ml denatured salmon sperm DNA at 68° C.,
e) 6×SSC, 0.5% SDS, 100 mg/ml denatured fragmented salmon sperm DNA, 50% formamide at 42° C.,
f) 50% formamide, 4×SSC at 42° C.,
g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
h) 2× or 4×SSC at 50° C. (low-stringency condition), or
i) 30 to 40% formamide, 2× or 4×SSC at 42° C. (low-stringency condition).

(2) Wash steps can be selected, for example, from the following conditions:
a) 0.015 M NaCl/0.0015 M sodium citrate/0.1% SDS at 50° C.
b) 0.1×SSC at 65° C.
c) 0.1×SSC, 0.5% SDS at 68° C.
d) 0.1×SSC, 0.5% SDS, 50% formamide at 42° C.
e) 0.2×SSC, 0.1% SDS at 42° C.
f) 2×SSC at 65° C. (low-stringency condition).

Polypeptides having above-mentioned activity, i.e. conferring a threonine increase, derived from other organisms, can be encoded by other DNA sequences which hybridize to a sequences indicated in Table IA or IB, columns 5 or 7, lines 6 to 15, 339 to 355 under relaxed hybridization conditions and which code on expression for peptides having the threonine increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the respective fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridising with the nucleic acid molecule of the invention or the nucleic acid molecule used in the method of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the respective fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences indicated in Table IA or IB, columns 5 or 7, lines 6 to 15, 339 to 355 is one which is sufficiently complementary to one of said nucleotide sequences such that it can hybridize to one of said nucleotide sequences thereby forming a stable duplex. Preferably, the hybridisation is performed under stringent hybrization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence indicated in Table IA or IB, columns 5 or 7, lines 6 to 15, 339 to 355 or a functional portion thereof and preferably has above mentioned activity, in particular has the-fine-chemical-increasing activity after increasing its activity or an activity of a product of a gene encoding said sequence or its homog's.

The nucleic acid molecule of the invention comprises a nucleotide sequence which hybridizes, preferably hybridizes under stringent conditions as defined herein, to one of the nucleotide sequences indicated in Table IA or IB, columns 5 or 7, lines 6 to 15, 339 to 355 or a portion thereof and encodes a protein having above-mentioned activity, e.g. conferring an increase of the fine chemical.

Optionally, the nucleotide sequence, which hybridises to one of the nucleotide sequences indicated in Table IA or IB, columns 5 or 7, lines 6 to 15, 339 to 355 has further one or more of the activities annotated or known for the a protein as indicated in Table IIA or IIB, column 3, lines 6 to 15, 339 to 355.

Moreover, the nucleic acid molecule of the invention can comprise only a portion of the coding region of one of the sequences indicated in Table IA or IB, columns 5 or 7, lines 6 to 15, 339 to 355 for example a fragment which can be used as a probe or primer or a fragment encoding a biologically active portion of the polypeptide of the present invention or of a polypeptide used in the process of the present invention, i.e. having above-mentioned activity, e.g. conferring an increase of fine chemical threonine if its activity is increased. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences indicated in Table IA or IB, columns 5 or 7, lines 6 to 15, 339 to 355, an anti-sense sequence of one of the sequences indicated in Table IA or IB, columns 5 or 7, lines 6 to 15, 339 to 355 or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primer pairs indicated in Table III, column 7, lines 6 to 15, 339 to 355 will result in a fragment of a polynucleotide sequence as indicated in Table IA or IB, columns 5 or 7, lines 6 to 15, 339 to 355.

Primer sets are interchangeable. The person skilled in the art knows to combine said primers to result in the desired product, e.g. in a full-length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention encodes a polypeptide or portion thereof which includes an amino acid sequence which is sufficiently homologous to an amino acid sequence as indicated in Table IIA or IIB, columns 5 or 7, lines 6 to 15, 339 to 355 such that the protein or portion thereof maintains the ability to participate in threonine production, in particular a threonine increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as indicated in Table IIA or IIB, columns 5 or 7, lines 6 to 15, 339 to 355 such that the protein or portion thereof is able to participate in the increase of threonine production. In one embodiment, a protein or portion thereof as indicated in Table IIA or IIB, columns 5 or 7, lines 6 to 15, 339 to 355 has for example an activity of a polypeptide indicated in Table IIA or IIB, column 3, lines 6 to 15, 339 to 355.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence as indicated in Table IIA or IIB, columns 5 or 7, lines 6 to 15, 339 to 355 and has above-mentioned activity, e.g. conferring preferably the increase of the fine chemical.

Portions of proteins encoded by the nucleic acid molecule of the invention or the nucleic acid molecule used in the method of the invention are preferably biologically active, preferably having above-mentioned annotated activity, e.g. conferring a increase the respective fine chemical after increase of activity.

As mentioned herein, the term "biologically active portion" is intended to include a portion, e.g., a domain/motif, that confers increase of the respective fine chemical or has an immunological activity such that it is binds to an antibody binding specifically to the polypeptide of the present invention or a polypeptide used in the process of the present invention for producing the respective fine chemical;

The invention further relates to nucleic acid molecules that differ from one of a nucleotide sequences as indicated in Table IA or IB, columns 5 or 7, lines 6 to 15, 339 to 355 (and portions thereof) due to degeneracy of the genetic code and thus encode a polypeptide of the present invention, in particular a polypeptide having above mentioned activity, e.g. conferring an increase in threonine in an organism, e.g. as that polypeptides comprising the consensus sequences as indicated in Table IV, columns 5 or 7, lines 6 to 15, 339 to 355 or of the polypeptide as indicated in Table IIA or IIB, columns 5 or 7, lines 6 to 15, 339 to 355 or their functional homologues. Advantageously, the nucleic acid molecule of the invention comprises, or in an other embodiment has, a nucleotide sequence encoding a protein comprising, or in another embodiment having, a consensus sequences as indicated in Table IV, columns 5 or 7, lines 6 to 15, 339 to 355 or of the polypeptide as as indicated in Table IIA or IIB, columns 5 or 7, lines 6 to 15, 339 to 355 or the functional homologues. In a still further embodiment, the nucleic acid molecule of the invention encodes a full length protein which is substantially homologous to an amino acid sequence comprising a consensus sequence as indicated in Table IV, column 7, lines 6 to 15, 339 to 355, or of a polypeptide as indicated in Table IIA or IIB, columns 5 or 7, lines 6 to 15, 339 to 355 or the functional homologues thereof. However, in a preferred embodiment, the nucleic acid molecule of the present invention does not consist of a sequence as indicated in Table IA columns 5 or 7, lines 6 to 15, 339 to 355.

In addition, it will be appreciated by those skilled in the art that DNA sequence polymorphisms that lead to changes in the amino acid sequences may exist within a population. Such genetic polymorphism in the gene encoding the polypeptide of the invention or the polypeptide used in the method of the invention or comprising the nucleic acid molecule of the invention or the nucleic acid molecule used in the method of the invention may exist among individuals within a population due to natural variation.

As used herein, the terms "gene" and "recombinant gene" refer to nucleic acid molecules comprising an open reading frame encoding the polypeptide of the invention or the polypeptide used in the method of the invention or comprising the nucleic acid molecule of the invention or the nucleic acid molecule used in the method of the invention or encoding the polypeptide used in the process of the present invention, preferably from a crop plant or from a microorganism useful for the production of respective fine chemicals, in particular for the production of the respective fine chemical. Such natural variations can typically result in 1-5% variance in the nucleotide sequence of the gene. Any and all such nucleotide variations and resulting amino acid polymorphisms in genes encoding a polypeptide of the invention or the polypeptide used in the method of the invention or comprising a the nucleic acid molecule of the invention or the nucleic acid molecule used in the method of the invention that are the result of natural variation and that do not alter the functional activity as described are intended to be within the scope of the invention.

Nucleic acid molecules corresponding to natural variants homologues of a nucleic acid molecule of the invention or the nucleic acid molecule used in the method of the invention, which can also be a cDNA, can be isolated based on their homology to the nucleic acid molecules disclosed herein using the nucleic acid molecule of the invention or the nucleic acid molecule used in the method of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising a sequence as indicated in Table IA or IB, columns 5 or 7, lines 6 to 15, 339 to 355. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence as indicated in Table IA or IB, columns 5 or 7, lines 6 to 15, 339 to 355 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. as indicated in Table IA or IB, columns 5 or 7, lines 6 to 15, 339 to 355.

A "non-essential" amino acid residue is a residue that can be altered from the wild-type sequence of one without altering the activity of said polypeptide, whereas an "essential" amino acid residue is required for an activity as mentioned above, e.g. leading to an increase in the respective fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organism can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned activity, e.g. conferring an increase in the fine chemical in an organisms or parts thereof that contain changes in amino acid residues that are not essential for said activity. Such polypeptides differ in amino acid sequence from a sequence contained in a sequence as indicated in Table IIA or IIB, columns 5 or 7, lines 6 to 15, 339 to 355 yet retain said activity described herein. The nucleic acid molecule can comprise a nucleotide sequence encoding a polypeptide, wherein the polypeptide comprises an amino acid sequence at least about 50% identical to an amino acid sequence as indicated in Table IIA or IIB, columns 5 or 7, lines 6 to 15, 339 to 355 and is capable of participation in the increase of production of the fine chemical after increasing its activity, e.g. its expression. Preferably, the protein encoded by the nucleic acid molecule is at least about 60% identical to a sequence as indicated in Table IIA or IIB, columns 5 or 7, lines 6 to 15, 339 to 355 more preferably at least about 70% identical to one of the sequences as indicated in Table IIA or IIB, columns 5 or 7, lines 6 to 15, 339 to 355 even more preferably at least about 80%, 90% or 95% homologous to a sequence as indicated in Table IIA or IIB, columns 5 or 7, lines 6 to 15, 339 to 355 and most preferably at least about 96%, 97%, 98%, or 99% identical to the sequence as indicated in Table IIA or IIB, columns 5 or 7, lines 6 to 15, 339 to 355.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/ total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:
-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -l Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.].

Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence which has a 80% homology with sequence SEQ ID NO: 40199 at the nucleic acid level is understood as meaning a sequence which, upon comparison with the sequence SEQ ID NO: 40199 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
|---|---|---|---|
| Average match: | 2,912 | Average mismatch: | −2,003 |

For example a sequence which has a 80% homology with sequence SEQ ID NO: 40200 at the protein level is understood as meaning a sequence which, upon comparison with the sequence SEQ ID NO: 40200 by the above program algorithm with the above parameter set, has a 80% homology.

Functional equivalents derived from one of the polypeptides as indicated in Table IIA or IIB, columns 5 or 7, lines 6 to 15, 339 to 355 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table IIA or IIB, columns 5 or 7, lines 6 to 15, 339 to 355 according to the invention and are distinguished by essentially the same properties as a polypeptide as indicated in Table IIA or IIB, columns 5 or 7, lines 6 to 15, 339 to 355.

Functional equivalents derived from a nucleic acid sequence as indicated in Table IA or IB, columns 5 or 7, lines 6 to 15, 339 to 355 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of a polypeptides as indicated in Table IIA or IIB, columns 5 or 7, lines 6 to 15, 339 to 355 according to the invention and encode polypeptides having essentially the same properties as a polypeptide as indicated in Table IIA or IIB, columns 5 or 7, lines 6 to 15, 339 to 355.

"Essentially the same properties" of a functional equivalent is above all understood as meaning that the functional equivalent has above mentioned activity, e.g. conferring an increase in the respective fine chemical amount while increasing the amount of protein, activity or function of said functional equivalent in an organism, e.g. a microorganism, a plant or plant or animal tissue, plant or animal cells or a part of the same.

A nucleic acid molecule encoding an homologous to a protein sequence of as indicated in Table IIA or IIB, columns 5 or 7, lines 6 to 15, 339 to 355 can be created by introducing one or more nucleotide substitutions, additions or deletions into a nucleotide sequence of the nucleic acid molecule of the present invention, in particular as indicated in Table IA or IB, columns 5 or 7, lines 6 to 15, 339 to 355 such that one or more amino acid substitutions, additions or deletions are introduced into the encoded protein. Mutations can be introduced into the encoding sequences of sequences as indicated in Table IA or IB, columns 5 or 7, lines 6 to 15, 339 to 355 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the respective fine chemical.

Following mutagenesis of one of the sequences shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with a sequence as indicated in Table IA or IB, columns 5 or 7, lines 6 to 15, 339 to 355, or of the nucleic acid sequences derived from a sequences as indicated in Table IIA or IIB, columns 5 or 7, lines 6 to 15, 339 to 355 comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from a sequence as indicated in Table IA or IB, columns 5 or 7, lines 6 to 15, 339 to 355 or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises one more sequence as indicated in Table IA or IB, columns 5 or 7, lines 6 to 15, 339 to 355. In one embodiment it is preferred that the nucleic acid molecule comprises as little as possible other nucleotide sequences not shown in any one of sequences as indicated in Table IA or IB, columns 5 or 7, lines 6 to 15, 339 to 355. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, a nucleic acid molecule use in the process of the invention is identical to a sequence as indicated in Table IA or IB, columns 5 or 7, lines 6 to 15, 339 to 355.

Also preferred is that one or more nucleic acid molecule(s) used in the process of the invention encodes a polypeptide comprising a sequence as indicated in Table IIA or IIB, columns 5 or 7, lines 6 to 15, 339 to 355. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment, the encoded polynucleotide used in the process of the invention is identical to the sequences as indicated in Table IIA or IIB, columns 5 or 7, lines 6 to 15, 339 to 355.

In one embodiment, the nucleic acid molecule of the invention or used in the process encodes a polypeptide comprising a sequence as indicated in Table IIA or IIB, columns 5 or 7, lines 6 to 15, 339 to 355 comprises less than 100 further nucleotides. In a further embodiment, said nucleic acid molecule comprises less than 30 further nucleotides. In one embodiment, the nucleic acid molecule used in the process is identical to a coding sequence encoding a sequences as indicated in Table IIA or IIB, columns 5 or 7, lines 6 to 15, 339 to 355.

Polypeptides (=proteins), which still have the essential enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as indicated in Table IIA or IIB, columns 5 or 7, lines 6 to 15, 339 to 355, preferably compared to a sequence as indicated in Table IIA or IIB, column 3 and 5, lines 6 to 15, 339 to 355 and expressed under identical conditions.

Homologues of sequences as indicated in Table IA or IB, columns 5 or 7, lines 6 to 15, 339 to 355 or of derived sequences as indicated in Table IIA or IIB, columns 5 or 7, lines 6 to 15, 339 to 355 also mean truncated sequences, cDNA, single-stranded DNA or RNA of the coding and non-coding DNA sequence. Homologues of said sequences are also understood as meaning derivatives which comprise non-coding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3' regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:

(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound respective fine chemical produced by the selected mutated organisms or parts thereof.

The organisms or part thereof produce according to the herein mentioned process of the invention an increased level of free and/or -bound respective fine chemical compared to said control or selected organisms or parts thereof.

In one embodiment, the organisms or part thereof produce according to the herein mentioned process of the invention an increased level of protein-bound respective fine chemical compared to said control or selected organisms or parts thereof.

Advantageously the selected organisms are mutagenized according to the invention. According to the invention mutagenesis is any change of the genetic information in the genome of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the respective fine chemical production.

The genes of the invention can also be activated by mutagenesis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagenesis as well as the respective agens is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagenesis with N-methyl-N-nitro-nitroso-guanidine.

Other biological method are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungi, a yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention originate from bacteria, for example from Proteobacteria, in particular from Gammaproteobacteria, more preferred from Enterobacteriales, e.g. from the family Enterobacteriaceae, particularly from genera *Escherichia, Salmonella, Klebsiella*, advantageously form the species *Escherichia coli* K12.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; Glycine max*; sunflower linseed or maize or their homologues.

Accordingly, in one embodiment, the invention relates to a nucleic acid molecule which comprises a nucleic acid molecule selected from the group consisting of:
(a) nucleic acid molecule encoding, preferably at least the mature form, of a polypeptide as indicated in Table II, columns 5 or 7, lines 6 to 15, 339 to 355, preferably of Table IIB, column 7, lines 6 to 15, lines 339 to 355 or a fragment thereof conferring an increase in the amount of the respective fine chemical threonine in an organism or a part thereof
(b) nucleic acid molecule comprising, preferably at least the mature form, of a nucleic acid molecule as indicated in Table I, columns 5 or 7, lines 6 to 15, 339 to 355, preferably of Table IB, column 7, lines 6 to 15, lines 339 to 355 or a fragment thereof conferring an increase in the amount of the respective fine chemical threonine in an organism or a part thereof;
(c) nucleic acid molecule whose sequence can be deduced from a polypeptide sequence encoded by a nucleic acid molecule of (a) or (b) as result of the degeneracy of the genetic code and conferring an increase in the amount of the respective fine chemical threonine in an organism or a part thereof;
(d) nucleic acid molecule encoding a polypeptide whose sequence has at least 50% identity with the amino acid sequence of the polypeptide encoded by the nucleic acid molecule of (a) to (c) and conferring an increase in the amount of the respective fine chemical threonine in an organism or a part thereof;
(e) nucleic acid molecule which hybridizes with a nucleic acid molecule of (a) to (c) under stringent hybridisation conditions and conferring an increase in the amount of the respective fine chemical threonine in an organism or a part thereof;
(f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the respective fine chemical threonine in an organism or a part thereof;

(g) nucleic acid molecule encoding a fragment or an epitope of a polypeptide which is encoded by one of the nucleic acid molecules of (a) to (e), preferably to (a) to (c) and conferring an increase in the amount of the respective fine chemical threonine in an organism or a part thereof;

(h) nucleic acid molecule comprising a nucleic acid molecule which is obtained by amplifying a cDNA library or a genomic library using primers or primer pairs as indicated in Table IIIA or IIIB, column 7, lines 6 to 15, 339 to 355 and conferring an increase in the amount of the respective fine chemical threonine in an organism or a part thereof;

(i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the respective fine chemical threonine in an organism or a part thereof;

(j) nucleic acid molecule which encodes a polypeptide comprising the consensus sequence as indicated in Table IV, column 7, lines 6 to 15, 339 to 355 and conferring an increase in the amount of the respective fine chemical threonine in an organism or a part thereof;

(k) nucleic acid molecule encoding the amino acid sequence of a polypeptide encoding a domain of a polypeptide as indicated in Table II, columns 5 or 7, lines 6 to 15, 339 to 355, preferably of Table IIB, column 7, lines 6 to 15, lines 339 to 355 and conferring an increase in the amount of the respective fine chemical threonine in an organism or a part thereof; and (l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of a nucleic acid molecule as indicated in Table I, columns 5 or 7, lines 6 to 15, 339 to 355, preferably of Table IB, column 7, lines 6 to 15, lines 339 to 355 or a nucleic acid molecule encoding, preferably at least the mature form of, the polypeptide as indicated in Table II, columns 5 or 7, lines 6 to 15, 339 to 355, preferably of Table IIB, column 7, lines 6 to 15, lines 339 to 355 and conferring an increase in the amount of the respective fine chemical threonine in an organism or a part thereof;

or which encompasses a sequence which is complementary thereto;

whereby, preferably, the nucleic acid molecule according to (a) to (l) distinguishes over a sequence depicted in as indicated in Table IA or IB, columns 5 or 7, lines 6 to 15, 339 to 355 by one or more nucleotides. In one embodiment, the nucleic acid molecule of the invention does not consist of a sequence as indicated in Table IA or IB, columns 5 or 7, lines 6 to 15, 339 to 355. In one embodiment, the nucleic acid molecule is less than 100%, 99.999%, 99.99%, 99.9% or 99% identical to a sequence indicated in Table I A or I B, columns 5 or 7, lines 6 to 15, 339 to 355. In another embodiment, the nucleic acid molecule does not encode a polypeptide of a sequence indicated in Table II A or II B, columns 5 or 7, lines 6 to 15, 339 to 355. In an other embodiment, the nucleic acid molecule of the present invention is at least 30%, 40%, 50%, or 60% identical and less than 100%, 99.999%, 99.99%, 99.9% or 99% identical to a sequence indicated in Table I A or I B, columns 5 or 7, lines 6 to 15, 339 to 355. In a further embodiment the nucleic acid molecule does not encode a polypeptide sequence as indicated in Table II A or II B, columns 5 or 7, lines 6 to 15, 339 to 355. Accordingly, in one embodiment, the nucleic acid molecule of the differs at least in one or more residues from a nucleic acid molecule indicated in Table I A or I B, columns 5 or 7, lines 6 to 15, 339 to 355. Accordingly, in one embodiment, the nucleic acid molecule of the present invention encodes a polypeptide, which differs at least in one or more amino acids from a polypeptide indicated in Table II A or I B, columns 5 or 7, lines 6 to 15, 339 to 355. In another embodiment, a nucleic acid molecule indicated in Table I A or I B, columns 5 or 7, lines 6 to 15, 339 to 355 does not encode a protein of a sequence indicated in Table II A or II B, columns 5 or 7, lines 6 to 15, 339 to 355. Accordingly, in one embodiment, the protein encoded by a sequences of a nucleic acid according to (a) to (l) does not consist of a sequence as indicated in Table II A or II B, columns 5 or 7, lines 6 to 15, 339 to 355. In a further embodiment, the protein of the present invention is at least 30%, 40%, 50%, or 60% identical to a protein sequence indicated in Table II A or II B, columns 5 or 7, lines 6 to 15, 339 to 355 and less than 100%, preferably less than 99.999%, 99.99% or 99.9%, more preferably less than 99%, 985, 97%, 96% or 95% identical to a sequence as indicated in Table I A or II B, columns 5 or 7, lines 6 to 15, 339 to 355.

The nucleic acid sequences used in the process are advantageously introduced in a nucleic acid construct, preferably an expression cassette which makes possible the expression of the nucleic acid molecules in an organism, advantageously a plant or a microorganism.

Accordingly, the invention also relates to an nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:
(a) introducing of a nucleic acid construct comprising the nucleic acid molecule of the invention or used in the process of the invention or encoding the polypeptide of the present invention or used in the process of the invention; or
(b) introducing of a nucleic acid molecule, including regulatory sequences or factors, which expression increases the expression of the nucleic acid molecule of the invention or used in the process of the invention or encoding the polypeptide of the present invention or used in the process of the invention;
   in a cell, or an organism or a part thereof, preferably in a plant, plant cell or a microorganism, and
(c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned in particular are various binary and cointegrated vector systems which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula, Pichia, Yerrowia, Saccharomyces, Schizosaccharomyces* or *Candida*.

Host organisms which are especially advantageously selected in the process according to the invention are microorganisms selected from the group of the genera and species consisting of *Hansenula anomala, Candida utilis, Claviceps purpurea, Bacillus circulans, Bacillus subtilis, Bacillus* sp.,

*Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the first alternative, the constructs, which comprise the codogenic gene segment or the nucleic acid molecule of the invention or the nucleic acid molecule used in the method of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansims.

In addition to a sequence as indicated in Table IA or IB, columns 5 or 7, lines 6 to 15, 339 to 355 or its derivatives, it is advantageous additionally to express and/or mutate further genes in the organisms. Especially advantageously, additionally at least one further gene of the amino acid biosynthetic pathway such as for L-lysine, L-methionine and/or L-threonine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acid desired since, for example, feedback regulations no longer exist to the same extent or not at all. In addition it might be advantageously to combine sequences as indicated in Table IA or IB, columns 5 or 7, lines 6 to 15, 339 to 355 with genes which generally support or enhances to growth or yield of the target organismen, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the amino acid metabolism, in particular in amino acid synthesis.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine. Furthermore, an advantageous nucleic acid sequence coexpressed can be threonine adlolase and/or lysine decarboxylase as described in the state of the art.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the respective fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60, 70, 80 or 90%, compared with the starting organism, and thus the activity of the enzyme is increased by these figures mentioned compared with the starting organism. An increase in the enzymatic activity means an enzymatic activity which is increased by at least 10%, advantageously at least 20, 30, 40 or 50%, particularly advantageously by at least 60, 70, 80, 90, 100, 200, 300, 500 or 1000%, compared with the starting organism. This leads to an increased productivity of the desired respective fine chemical or of the desired respective fine chemicals.

In a further advantageous embodiment of the process of the invention, the organisms used in the process are those in which simultaneously a threonine degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or the nucleic acid molecule used in the method of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to the coding sequence of the nucleic acid molecule of the invention or the nucleic acid molecule used in the method of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the Ω enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a A/T-rich sequence which act as quantitative enhancers of gene expression in transgenic tobacco and potato plants (Sandhu et al., 1998; Plant Mol. Biol. 37(5):885-96). Beside that, a large variety of cis-active elements have been described which contribute to specific expression pattern, like organ specific expression or induced expression in response to biotic or abiotic stress. Examples are elements which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, lacI$^{q-}$, T7, T5, T3, gal, trc, ara, SP6, $\lambda$-P$_R$ or $\lambda$-P$_L$ promoter, which are advantageously used in Gram-negative bacteria. Further advantageous regulatory sequences are present for example in the Gram-positive promoters amy, dnaK, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4–, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention or the nucleic acid molecule used in the method of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein.

This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination arepolyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell Targeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention a plant can be advantageous. However, inducible expression of the polypeptide of the invention or the polypeptide used in the method of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinll promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the inventioncomprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the respective fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signalsThese regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.:583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion E. coli expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage which harbors a T7 gn1 gene under the transcriptional control of the lacUV 5 promoter.

Other vectors which are suitable in prokaryotic organisms are known to the skilled worker; these vectors are for example in *E. coli* pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III[113]-B1, λgt11 or pBdCl, in *Streptomyces* pIJ101, pIJ364, pIJ702 or pIJ361, in *Bacillus* pUB110, pC194 or pBD214, in *Corynebacterium* pSA77 or pAJ667.

In a further embodiment, the expression vector is a yeast expression vector. Examples of vectors for expression in the yeasts *S. cerevisiae* encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 μM, pAG-1, YEp6, YEp13 or pEMBLYe23.

Further vectors, which may be mentioned by way of example, are pALS1, pIL2 or pBB116 in fungi or pLGV23, pGHlac$^+$, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell. Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The amino acids produced can be isolated from the organism by methods with which the skilled worker is familiar. For example via extraction, salt precipitation and/or ion-exchange chromatography. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas (Bioreaktoren and periphere Einrichtungen (Vieweg Verlag, Braunschweig/Wiesbaden, 1994)).

In one embodiment, the present invention relates to a polypeptide encoded by the nucleic acid molecule according to the present invention, preferably conferring an increase in the respective fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with an eukaryotic organism as host cell. E.g., in one embodiment the polypeptide is produced in a plant cell or plant with a nucleic acid molecule derived from a prokaryote or a fungus or an alga or an other microorganism but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in E. coli there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, a native polypeptide conferring the increase of the fine chemical threonine in an organism or part thereof can be isolated from cells (e.g., endothelial cells), for example using the antibody of the present invention as described below, in particular, an antibody against a protein as indicated in Table IIA or IIB, column 3, lines 6 to 15, 339 to 355. E.g. an antibody against a polypeptide as indicated in Table IIA or IIB, columns 5 or 7, lines 6 to 15, 339 to 355 which can be produced by standard techniques utilizing polypeptides comprising or consisting of above mentioned sequences, e.g. the polypeptide of the present invention or fragment thereof. Preferred are monoclonal antibodies.

In one embodiment, the present invention relates to a polypeptide having the amino acid sequence encoded by a nucleic acid molecule of the invention or the nucleic acid molecule used in the method of the invention or obtainable by a process of the invention. Said polypeptide confers preferably the aforementioned activity, in particular, the polypeptide confers the increase of the respective fine chemical in a cell or an organism or a part thereof after increasing the cellular activity, e.g. by increasing the expression or the specific activity of the polypeptide.

In one embodiment, the present invention relates to a polypeptide having a sequence as indicated in Table IIA or IIB, columns 5 or 7, lines 6 to 15, 339 to 355 or as coded by a nucleic acid molecule as indicated in Table IIA or IIB, columns 5 or 7, lines 6 to 15, 339 to 355 or functional homologues thereof.

In one advantageous embodiment, in the method of the present invention the activity of a polypeptide is increased which comprises or consists of a consensus sequence as indicated in Table IV, column 7, lines 6 to 15, 339 to 355 and in one other embodiment, the present invention relates to a polypeptide comprising or consisting of a consensus sequence as indicated in Table IV, column 7, lines 6 to 15, 339 to 355 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

In one embodiment not more than 15%, preferably 10%, even more preferred 5%, 4%, 3%, or 2%, most preferred 1% or 0% of the amino acid position indicated by a letter are/is replaced another amino acid or, in an other embodiment, are/is absent and/or replaced. In another embodiment the stretches of non-conserved amino acids, indicated by $(X)_n$ [whereas n indicates the number of X], vary in their length by 20%, preferably by 15 or 10%, even more preferred by 5%, 4%, 3%, 2% or most preferred by only 1%.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence or, in an other embodiment, are absent and/or replaced.

The consensus sequence shown herein was derived from a multiple alignment of the sequences as listed in table II. The consensus sequences of specified domains were derived from a multiple alignment of all sequences. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. YX(21-23)F means that conserved tyrosine and phenylalanine residues are separated from each other by minimum 21 and maximum 23 amino acid residues in all investigated sequences.

The alignment was performed with the Software AlignX (sept 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penality: 10.0; gap extension penalty 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 0.9. Presettings were selected to allow also for the alignment of conserved amino acids.

In one advantageous embodiment, the method of the present invention comprises the increasing of a polypeptide comprising or consisting of plant or microorganism specific consensus sequences.

Accordingly, in one embodiment, the present invention relates to a polypeptide comprising or consisting of plant or microorganism specific consensus sequences.

In one embodiment, said polypeptide of the invention distinguishes over a sequence as indicated in Table IIA or IIB, columns 5 or 7, lines 6 to 15, 339 to 355 by one or more amino acids. In one embodiment, the polypeptide distinguishes from a sequence as indicated in Table IIA or IIB, columns 5 or 7, lines 6 to 15, 339 to 355 by more than 1, 2, 3, 4, 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from a sequence as indicated in Table IIA or IIB, columns 5 or 7, lines 6 to 15, 339 to 355 by not more than 80% or 70% of the amino acids, preferably not more than 60% or 50%, more preferred not more than 40% or 30%, even more preferred not more than 20% or 10%. In another embodiment, said polypeptide of the invention does not consist of a sequence as indicated in Table IIA or IIB, columns 5 or 7, lines 6 to 15, 339 to 355.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to a polypeptide conferring an increase in the fine chemical threonine in an organism or part being encoded by the nucleic acid molecule of the invention or by the nucleic acid molecule of the invention used in the process of the invention.

In one embodiment, the polypeptide of the invention is having a sequence which distinguishes from a sequence as indicated in Table IIA or IIB, columns 5 or 7, lines 6 to 15, 339 to 355 by one or more amino acids. In another embodiment, said polypeptide of the invention does not consist of the sequence as indicated in Table IIA or IIB, columns 5 or 7, lines 6 to 15, 339 to 355. In a further embodiment, said polypeptide of the present invention is less than 100%, 99.999%, 99.99%, 99.9% or 99% identical. In one embodiment, said polypeptide does not consist of the sequence encoded by a nucleic acid molecules as indicated in Table IA or IB, columns 5 or 7, lines 6 to 15, 339 to 355.

In one embodiment, the present invention relates to a polypeptide having an activity of a protein as indicated in Table IIA or IIB, column 3, lines 6 to 15, 339 to 355, which distinguishes over a sequence as indicated in Table IIA or IIB, columns 5 or 7, lines 6 to 15, 339 to 355 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, poly-peptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized.

The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention-chemicals, more preferably less than about 20% chemical precursors or non-polypeptide of the invention-chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

Non-polypeptide of the invention-chemicals are e.g. polypeptides having not the activity and/or amino acid sequence of a polypeptide indicated in Table II, columns 3, 5 or 7, lines 1 to 5 and/or lines 334 to 338.

Non-polypeptide of the invention-chemicals are e.g. polypeptides having not the activity of a polypeptide indicated in Table IIA or IIB, columns 3, 5 or 7, lines 6 to 15, 339 to 355.

A polypeptide of the invention can participate in the process of the present invention. The polypeptide or a portion thereof comprises preferably an amino acid sequence which is sufficiently homologous to an amino acid sequence as indicated in Table IIA or IIB, columns 5 or 7, lines 6 to 15, 339 to 355 such that the protein or portion thereof maintains the ability to confer the activity of the present invention. The portion of the protein is preferably a biologically active portion as described herein. Preferably, the polypeptide used in the process of the invention has an amino acid sequence identical to a sequence as indicated in Table IIA or IIB, columns 5 or 7, lines 6 to 15, 339 to 355.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the nucleotide sequence as indicated in Table IA or IB, columns 5 or 7, lines 6 to 15, 339 to 355. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence as indicated in Table IA or IB, columns 5 or 7, lines 6 to 15, 339 to 355 or which is homologous thereto, as defined above.

Accordingly the polypeptide of the present invention can vary from a sequence as indicated in Table IIA or IIB, columns 5 or 7, lines 6 to 15, 339 to 355 in the amino acid sequence due to natural variation or mutagenesis, as described in detail herein. Accordingly, the polypeptide comprises an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of a sequence as indicated in Table IIA or IIB, columns 5 or 7, lines 6 to 15, 339 to 355.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of a polypeptide of the present invention include peptides comprising amino acid sequences derived from the amino acid sequence of the polypeptide of the present invention or used in the process of the present invention, e.g., an amino acid sequence as indicated in Table IIA or IIB, columns 5 or 7, lines 6 to 15, 339 to 355 or the amino acid sequence of a protein homologous thereto, which include fewer amino acids than a full length polypeptide of the present invention or used in the process of the present invention or the full length protein which is homologous to a polypeptide of the present invention or used in the process of the present invention depicted herein, and exhibit at least one activity of a polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of a protein having essentially the activity of the polypeptides as indicated in Table IIA or IIB, column 3, lines 6 to 15, 339 to 355 but having differences in the sequence from said wild-type protein. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention or the polypeptide used in the method of the invention may be utilized to generate plants or parts thereof, expressing one or more wildtype protein(s) or one or more mutated protein encoding nucleic acid molecule(s) or polypeptide molecule(s) of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition comprising the respective fine chemical or a recovered respective fine chemical, in particular, the fine chemical, free or in protein-bound form.

Preferably, the compound is a composition comprising the methionine or a recovered methionine, in particular, the fine chemical, free or in protein-bound form.

The invention also provides chimeric or fusion proteins.

As used herein, an "chimeric protein" or "fusion protein" comprises an polypeptide operatively linked to a polypeptide which does not confer above-mentioned activity, in particular, which does not confer an increase of content of the respective fine chemical in a cell or an organism or a part thereof, if its activity is increased.

In one embodiment, an reference to a "protein (=polypeptide)" of the invention or as indicated in Table IIA or IIB, columns 5 or 7, lines 6 to 15, 339 to 355 refers to a polypeptide having an amino acid sequence corresponding to the polypeptide of the invention or used in the process of the invention, whereas a "non-polypeptide of the invention" or "other polypeptide" not being indicated in Table IIA or IIB, columns 5 or 7, lines 6 to 15, 339 to 355 refers to a polypeptide having an amino acid sequence corresponding to a protein which is not substantially homologous to a polypeptide of the invention, preferably which is not substantially homologous to a polypeptide as indicated in Table IIA or IIB, columns 5 or 7, lines 6 to 15, 339 to 355 e.g., a protein which does not confer the activity described herein or annotated or known for as indicated in Table IIA or IIB, column 3, lines 6 to 15, 339 to 355 and which is derived from the same or a different organism. In one embodiment a "non-polypeptide of the invention" or "other polypeptide" not being indicate in Table IIA or IIB, columns 5 or 7, lines 6 to 15, 339 to 355 does not confer an increase of the fine chemical in an organism or part thereof.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a polypeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention or the nucleic acid molecule used in the method of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modelling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention or the polypeptide used in the method of the invention and its substrates or binding factors can be used for the identification or design of mutants with modulated binding or turn over activities. For example, the active centre of the polypeptide of the present invention can be modelled and amino acid residues participating in the catalytic reaction can be modulated to increase or decrease the binding of the substrate to activate or improve the polypeptide. The identification of the active centre and the amino acids involved in the catalytic reaction facilitates the screening for mutants having an increased activity.

The sequences shown in column 5 of the Tables I to IV herein have also been described under their Gene/ORF Locus Name as described in the Table I, II, III or IV, column 3.

In an especially preferred embodiment, the polypeptide according to the invention furthermore also does not have the sequences of those proteins which are encoded by the sequences shown in the known listed Gene/ORF Locus Names or as described in the Tables, column 3.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof. The "anti-sense strand" contains an inverted sequence, which is complementary to that of the "sense strand".

In addition the expression levels and/or the activity can be modified by the introduction of mutations in the regulatory or coding regions of the nucleic acids of the invention. Furthermore antibodies can be expressed which specifically binds to a polypeptide of interest and thereby blocks it activity. The protein-binding factors can, for example, also be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention or the nucleic acid molecule used in the method of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5'-UTR or 3'-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule to the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention or the nucleic acid molecule used in the method of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methyl-inosine, 2,2-dimethylguanine, 2-methyladenine, 2-methylguanine, 3-methylcytosine, 5-methylcytosine, N6-adenine, 7-methylguanine, 5-methylaminomethyluracil, 5-meth-oxyaminomethyl-2-thiouracil, beta-D-mannosylqueosine, 5'-methoxycarboxymethyl-uracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy-acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention or the polypeptide used in the method of the invention having aforementioned the respective fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention or the nucleic acid molecule used in the method of the invention can be an α-anomeric nucleic acid molecule. An α-anomeric nucleic acid molecule forms specific double-stranded hybrids with complementary RNA in which, contrary to the usual units, the strands run parallel to each other (Gaultier et al. (1987) *Nucleic Acids. Res.* 15:6625-6641). The antisense nucleic acid molecule can also comprise a 2'-o-methyl-ribonucleotide (Inoue et al. (1987) *Nucleic Acids Res.* 15:6131-6148) or a chimeric RNA-DNA analogue (Inoue et al. (1987) *FEBS Lett.* 215:327-330).

Further the antisense nucleic acid molecule of the invention or the nucleic acid molecule used in the method of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts encoding the polypeptide of the invention or the polypeptide used in the method of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or the nucleic acid molecule used in the method of the invention or coding a protein used in the process of the invention or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J. W. (1993) *Science* 261:1411-1418.

The antisense molecule of the present invention comprises also a nucleic acid molecule comprising a nucleotide sequences complementary to the regulatory region of an nucleotide sequence encoding the natural occurring polypeptide of the invention or the polypeptide used in the method of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6): 569-84; Helene, C. et al. (1992) *Ann. N.Y. Acad. Sci.* 660:27-36; and Maher, L. J. (1992) *Bioassays* 14(12): 807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as *Neurospora, zebrafish, Drosophila*, mice, planaria, humans, *Trypanosoma, petunia* or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of a nucleic acid sequences as indicated in Table II A or IIB, columns 5 or 7, lines 6 to 15, 339 to 355 and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived therefrom), bring about altered metabolic activity by the reduction in the expression of a nucleic acid sequences as indicated in Table IA or IB, columns 5 or 7, lines 6 to 15, 339 to 355 and/or homologs thereof. In a double-stranded RNA molecule for reducing the expression of an protein encoded by a nucleic acid sequence of one of the sequences as indicated in Table IIA or IIB, columns 5 or 7, lines 6 to 15, 339 to 355 and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in non-mammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence as indicated in Table IA or IB, columns 5 or 7, lines 6 to 15, 339 to 355 or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence as indicated in Table IA or IB, columns 5 or 7, lines 6 to 15, 339 to 355 or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804,693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extra-cellularly (for example into the interstitial space).

Advantageously the RNAi method leads to only a partial loss of gene function and therefore enables the skilled worker to study a gene dose effect in the desired organism and to fine tune the process of the invention. Furthermore it enables a person skilled in the art to study multiple functions of a gene. Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the respective fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as R-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with Agrobacteria, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Agrobacteria transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J and Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol. Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22 (2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the fine chemical threonine in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. the polypeptide as indicated in Table IIA or IIB, columns 5 or 7, lines 6 to 15, 339 to 355. Due to the above mentioned activity the fine chemical content in a cell or an organism is increased. For example, due to modulation or manupulation, the cellular activity of the polypeptide of the invention or nucleic acid molecule of the invention is increased, e.g. due to an increased expression or specific activity of the subject matters of the invention in a cell or an organism or a part thereof. In one embodiment transgenic for a polypeptide having an activity of a polypeptide as indicated in Table IIA or IIB, columns 5 or 7, lines 6 to 15, 339 to 355 means herein that due to modulation or manipulation of the genome, an activity as annotated for a polypeptide as indicated in Table IIA or IIB, columns 3, lines 6 to 15, 339 to 355, e.g. having a sequence as indicated in Table IIA or IIB, columns 5 or 7, lines 6 to 15, 339 to 355 is increased in a cell or an organism or a part thereof. Examples are described above in context with the process of the invention.

"Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either
a) the nucleic acid sequence, or
b) a genetic control sequence linked operably to the nucleic acid sequence, for example a promoter, or
c) (a) and (b)
are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of a promoter of a polypeptide of the invention with the corresponding protein-encoding-sequence—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the respective fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the respective fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the above-mentioned plant genus, more preferred from abovementioned plants species.

Transgenic plants comprising the amino acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The amino acids produced in the process according to the invention may, however, also be isolated from the plant in the form of their free amino acids or bound in proteins. Amino acids produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention or the nucleic acid molecule used in the method of the invention.

In another embodiment, the present invention relates also to a transgenic microorganism comprising the nucleic acid molecule of the invention or the nucleic acid molecule used in the method of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced amino acid composition or the produced respective fine chemical is isolated.

In this manner, more than 50% by weight, advantageously more than 60% by weight, preferably more than 70% by weight, especially preferably more than 80% by weight, very especially preferably more than 90% by weight, of the fine chemicals produced in the process can be isolated. The resulting fine chemicals can, if appropriate, subsequently be further purified, if desired mixed with other active ingredients such as vitamins, amino acids, carbohydrates, antibiotics and the like, and, if appropriate, formulated.

In one embodiment, the fatty acid is the fine chemical.

The amino acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the amino acid composition produced or the fine chemical produced if desired and formulating the product with a pharmaceutical acceptable carrier or formulating the product in a form acceptable for an application in agriculture. A further embodiment according to the invention is the use of the amino acids produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus*, *Corynebacterium*, *Micrococcus*, *Brevibacterium*, *Rhodococcus*, *Nocardia*, *Caseobacter* or *Arthrobacter* or Gram-negative bacteria such as the genera *Escherichia*, *Flavobacterium* or *Salmonella* or yeasts such as the genera *Rhodotorula*, *Hansenula* or *Candida*. Particularly advantageous organisms are selected from the group of genera *Corynebacterium*, *Brevibacterium*, *Escherichia*, *Bacillus*, *Rhodotorula*, *Hansenula*, *Candida*, *Claviceps* or *Flavobacterium*. It is very particularly advantageous to use in the process of the invention microorganisms selected from the group of genera and species consisting of *Hansenula anomala*, *Candida utilis*, *Claviceps purpurea*, *Bacillus circulans*, *Bacillus subtilis*, *Bacillus* sp., *Brevibacterium albidum*, *Brevibacterium album*, *Brevibacterium cerinum*, *Brevibacterium flavum*, *Brevibacterium glutamigenes*, *Brevibacterium iodinum*, *Brevibacterium ketoglutamicum*, *Brevibacterium lactofermentum*, *Brevibacterium linens*, *Brevibacterium roseum*, *Brevibacterium saccharolyticum*, *Brevibacterium* sp., *Corynebacterium acetoacidophilum*, *Corynebacterium acetoglutamicum*, *Corynebacterium ammoniagenes*, *Corynebacterium glutamicum* (=*Micrococcus glutamicum*), *Corynebacterium melassecola*, *Corynebacterium* sp. or *Escherichia coli*, specifically *Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing hydroxy containing fine chemicals, in particular the fine chemical threonine, it is possible to use as hydroxy source organic hydroxy-containing compounds such as, for example, alcohols, hydroxy-containing organic acids, acetals, or compounds containing carbonyl or carboxyl groups to be reduced by known methods of the art.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P. M. Rhodes, P. F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular L-methionine, L-threonine and/or L-lysine, normally have a dry matter content of from 7.5 to 25% by weight. Sugar-limited fermentation is additionally advantageous, at least at the end, but especially over at least 30% of the fermentation time. This means that the concentration of utilizable sugar in the fermentation medium is kept at, or reduced to, 0 to 3 g/l during this time. The fermentation broth is then processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the amino acid produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavourings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the fine chemical production in a cell, comprising the following steps:
(a) contacting e.g. hybridising, the nucleic acid molecules of a sample, e.g. cells, tissues, plants or microorganisms or a nucleic acid library, which can contain a candidate gene encoding a gene product conferring an increase in the fine chemical threonine after expression, with the nucleic acid molecule of the present invention;
(b) identifying the nucleic acid molecules, which hybridize under relaxed stringent conditions with the nucleic acid molecule of the present invention in particular to the nucleic acid molecule sequence as indicated in Table IA or IB, columns 5 or 7, lines 6 to 15, 339 to 355 and, optionally, isolating the full length cDNA clone or complete genomic clone;
(c) introducing the candidate nucleic acid molecules in host cells, preferably in a plant cell or a microorganism, appropriate for producing the fine chemical threonine;
(d) expressing the identified nucleic acid molecules in the host cells;
(e) assaying the fine chemical level in the host cells; and
(f) identifying the nucleic acid molecule and its gene product which expression confers an increase in the fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In an other embodiment, the present invention relates to a method for the identification of a gene product conferring an increase in the respective fine chemical production in a cell, comprising the following steps:
(a) identifying nucleic acid molecules of an organism; which can contain a candidate gene encoding a gene product conferring an increase in the respective fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
(b) introducing the candidate nucleic acid molecules in host cells, preferably in a plant cells or microorganisms, appropriate for producing the respective fine chemical;
(c) expressing the identified nucleic acid molecules in the host cells;
(d) assaying the respective fine chemical level in the host cells; and
(e) identifying the nucleic acid molecule and its gene product which expression confers an increase in the respective fine chemical level in the host cell after expression compared to the wild type.

Eventually gene products conferring the increase in the respective fine chemical production can also be identify according to a identical or similar 3D structure in step (a) and by the above described method.

The nucleic acid molecules identified can then be used for the production of the respective fine chemical in the same way as the nucleic acid molecule of the present invention. Accordingly, in one embodiment, the present invention relates to a process for the production of the respective fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the respective fine chemical to said plant comprising:
a) contacting cells which express the polypeptide of the present invention or its mRNA with a candidate compound under cell cultivation conditions;
b) assaying an increase in expression of said polypeptide or said mRNA;
c) comparing the expression level to a standard response made in the absence of said candidate compound; whereby, an increased expression over the standard indicates that the compound is stimulating production of the respective fine chemical.

Furthermore, in one embodiment, the present invention relates to a method for the screening for agonists or an antagonist of the activity of the polypeptide of the present invention or used in the process of the present invention, e.g. a polypeptide conferring an increase of the respective fine chemical in an organism or a part thereof after increasing the activity in an organism or a part thereof, comprising:
(a) contacting cells, tissues, plants or microorganisms which express the polypeptide according to the invention with a candidate compound or a sample comprising a plurality of compounds under conditions which permit the expression the polypeptide of the present invention or used in the process of the present invention;
(b) assaying the respective fine chemical level or the polypeptide expression level in the cell, tissue, plant or microorganism or the media the cell, tissue, plant or microorganisms is cultured or maintained in; and
(c) identifying a agonist or antagonist by comparing the measured the respective fine chemical level or polypeptide of the invention or used in the invention expression level with a standard the respective fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to a process for the identification of a compound conferring increased in the fine chemical production in a plant or microorganism, comprising the steps:
(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and
(b) identifying if the compound is an effective agonist by detecting the presence or absence or increase of a signal produced by said readout system.

The screen for a gene product or an agonist conferring an increase in the fine chemical production can be performed by growth of an organism for example a microorganism in the presence of growth reducing amounts of an inhibitor of the synthesis of the fine chemical. Better growth, e.g. higher dividing rate or high dry mass in comparison to the control under such conditions would identify a gene or gene product or an agonist conferring an increase in fine chemical production.

One can think to screen for increased production of the fine chemical threonine by for example searching for a resistance to a drug blocking the synthesis of the fine chemical threonine and looking whether this effect is dependent on the activity or expression of a polypeptide as indicated in Table IIA or IIB, columns 5 or 7, lines 6 to 15, 339 to 355 or a homolog thereof, e.g. comparing the phenotype of nearly identical organisms with low and high activity of a protein as indicated in Table IIA or IIB, columns 5 or 7, lines 6 to 15, 339 to 355 after incubation with the drug.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the respective fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the respective fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the arm, e.g. buffers and solutions for hybridization assays, e.g. the aforementioned solutions and buffers, further and means for Southern-, Western-, Northern—etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the respective fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or the polypeptide used in the method of the invention or comprising the steps of the method according to the invention for the identification of said compound, agonist or antagonist; and formulating the nucleic acid molecule, the vector or the polypeptide of the invention or the polypeptide used in the method of the invention or the agonist, or compound identified according to the methods or processes of the present invention or with use of the subject matters of the present invention in a form applicable as plant agricultural composition.

In another embodiment, the present invention relates to a method for the production of a "the respective fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the respective fine chemical production as mentioned and related organisms; mapping of genomes; identification and localization of sequences of interest; evolutionary studies; determination of regions required for function; modulation of an activity.

The nucleic acid molecule of the invention or the nucleic acid molecule used in the method of the invention, the vector of the invention or the nucleic acid construct of the invention may also be useful for the production of organisms resistant to inhibitors of the amino acid production biosynthesis pathways. In particular, the overexpression of the polypeptide of the present invention may protect plants against herbicides, which block the amino acid, in particular the respective fine chemical, synthesis in said plant. Inhibitors may inhibit one or more of the steps for the synthesis of methionine. The first committed step for the synthesis of Lys, Met and Thr is the first step, in which aspartate is phosphorylated to aspartyl-b-phosphate, catalyzed by aspartokinase: *E. coli* has 3 isozymes of aspartokinase that respond differently to each of the 3 amino acids, with regard to enzyme inhibition and feedback inhibition. The biosynthesis of lysine, methionine and threonine are not, then, controlled as a group. The pathway from aspartate to lysine has 10 steps. The pathway from aspartate to threonine has 5 steps. The pathway from aspartate to methionine has 7 steps. Regulation of the three pathways also occurs at the two branch points:

b-Aspartate-semialdehyde (homoserine and lysine)
Homoserine (threonine and methionine)

The regulation results from feedback inhibition by the amino acid products of the branches, indicated in the brackets above. One important step in the synthesis of this group of 3 amino acids is the step in which homocysteine is converted to methionine, catalyzed by the enzyme methionine synthase:

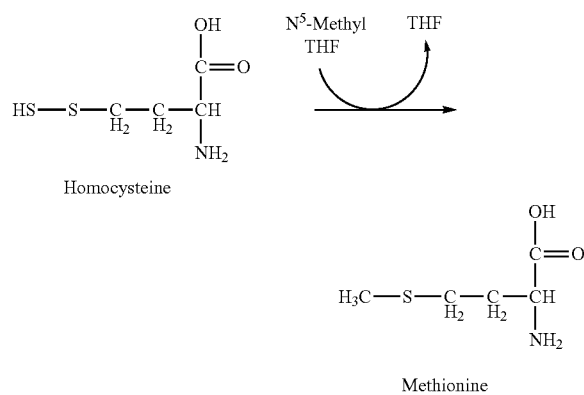

In this reaction, homocysteine is methylated to methionine, and the C1 donor is N5-methyl-THF. Thus, inhibition of one or more of the methionine synthesis enzymes, including also the provision of donor molecules, can inhibit the synthesis of methionine.

Examples of herbicides blocking the amino acid synthesis in plants are for example sulfonylurea and imidazolinone herbicides, which catalyze the first step in branched-chain amino acid biosynthesis. Inhibitors of the methionine synthesis may for example described in Danishpajooh IO, 2001 Nitric oxide inhibits methionine synthase activity in vivo and disrupts carbon flow through the folate pathway. J. Biol. Chem. 276: 27296-27303; Datko AH, 1982 Methionine biosynthesis in Lemna—inhibitor studies. Plant Physiol. 69: 1070-1076; Lavrador K, 1998 A new series of cyclic amino acids as inhibitors of S-adenosyl L-methionine synthetase. Bioorg. Med. Chem. Lett. 8: 1629-1634; Thompson G A, 1982 Methionine synthesis in Lemna—inhibition of cystathionine gamma-synthase by propargylglycine. Plant Physiol. 70: 1347-1352. In some organisms the methionine synthesis is inhibited by ethanol, lead, mercury, aluminium, thimerosal, cupper, N2O, as e.g. discussed in M. Waly, H. Oleteanu et al., 2004, Molecular Psychiatry, 1-13.

Interestingly, *Arabidopsis* seed germination was strongly delayed in the presence of DL-propargylglycine, a specific inhibitor of methionine synthesis. Furthermore, this compound totally inhibited seedling growth. These phenotypic effects were largely alleviated upon methionine supplementation in the germination medium. The results indicated that methionine synthase and S-adenosylmethionine synthetase are fundamental components controlling metabolism in the transition from a quiescent to a highly active state during seed germination. Moreover, the observed temporal patterns of accumulation of these proteins are consistent with an essential role of endogenous ethylene in *Arabidopsis* only after radicle protrusion; s. Gallarado, K., 2002, Importance of methionine biosynthesis for *Arabidopsis* seed germination and seedling growth, Physiolgia Plantarum, 116(2), pp 238-247. Accordingly, the overexpression of a polypeptide of the present invention in a plant may protect the plant against a herbicide inhibiting methionine synthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention or the nucleic acid molecule used in the method of the invention may be sufficiently homologous to the sequences of related species such that these nucleic acid molecules may serve as markers for the construction of a genomic map in related organism.

Accordingly, the present invention relates to a method for breeding plants for the production of the respective fine chemical, comprising
 (a) providing a first plant variety produced according to the process of the invention preferably (over)expressing the nucleic acid molecule of the invention or the nucleic acid molecule used in the method of the invention;
 (b) crossing the first plant variety with a second plant variety; and
 (c) selecting the offspring plants which overproduce the respective fine chemical by means of analysis the distribution of a molecular marker in the offspring representing the first plant variety and its capability to (over) produce the respective fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention or the nucleic acid molecule used in the method of the invention and/or its expression level. Accordingly, the molecular marker can be a probe or a PCR primer set useful for identification of the genomic existence or genomic localisation of the nucleic acid molecule of the invention or the nucleic acid molecule used in the method of the invention, e.g. in a Southern blot analysis or a PCR or its expression level, i.g. in a Northern Blot analysis or a quantitative PCR.

Accordingly, in one embodiment, the present invention relates to the use of the nucleic acid molecule of the present invention or encoding the polypeptide of the present invention as molecular marker for breeding, especially for breeding for a high or low respective fine chemical production.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention or the nucleic acid molecule used in the method of the invention can be used for the identification of other nucleic acids conferring an increase of the respective fine chemical after expression.

Further, the nucleic acid molecule of the invention or the nucleic acid molecule used in the method of the invention or a fragment of a gene conferring the expression of the polypeptide of the invention or the polypeptide used in the method of the invention, preferably comprising the nucleic acid molecule of the invention, can be used for marker assisted breeding or association mapping of the respective fine chemical derived traits Accordingly, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical or of the fine chemical and one or more other amino acids, in particular Threoinine, Alanine, Glutamin, Glutamic acid, Valine, Asparagine, Phenylalanine, Leucine, Proline, Tryptophan Tyrosine, Valine, Isoleucine and Arginine. Accordingly, the nucleic acid of the invention, or the nucleic acid molecule identified with the method of the present invention or the complement sequences thereof, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the respective fine chemical in a organism or part thereof, e.g. in a cell.

Further, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist or the agonist identified with the method of the invention, the antibody of the present invention, the antisense molecule of the present invention or the nucleic acid molecule identified with the method of the present invention, can be used for the preparation of an agricultural composition.

Furthermore, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, antagonist or the agonist identified with the method of the invention, the antibody of the present invention, the antisense molecule of the present invention or the nucleic acid molecule identified with the method of the present invention, can be used for the identification and production of compounds capable of conferring a modulation of the respective fine chemical levels in an organism or parts thereof, preferably to identify and produce compounds conferring an increase of the respective fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nlm.nih.gov/PubMed/medline.html. Further databases and addresses, such as hftp://www.ncbi.nlm.nih.gov/, hftp://www.infobiogen.fr/, hftp://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.

1) Increase of the metabolites:
   Max: maximal x-fold (normalised to wild type)-
   Min: minimal x-fold (normalised to wild type)
2) Decrease of the metabolites:
   Max: maximal x-fold (normalised to wild type) (minimal decrease)
   Min: minimal x-fold (normalised to wild type) (maximal decrease)

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning SEQ ID NO: 81 or Another DNA Polynucleotide According the Enclosed Sequence Listing Encoding an ORF as Shown in the Below Table in *Escherichia coli*

SEQ ID NO: 81 or another DNA polynucleotide according the enclosed sequence listing encoding an ORF as shown in the below table was cloned into the plasmids pBR322 (Sutcliffe, J. G. (1979) Proc. Natl. Acad. Sci. USA, 75: 3737-3741); pACYC177 (Change & Cohen (1978) J. Bacteriol. 134: 1141-1156); plasmids of the pBS series (pBSSK+, pBSSK- and others; Stratagene, LaJolla, USA) or cosmids such as SuperCosi (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of *Haemophilus Influenzae* Rd., Science 269; 496-512)".

Example 3

In-Vivo and In-Vitro Mutagenesis

An in vivo mutagenesis of *Corynebacterium glutamicum* for the production of the respective fine chemical can be carried out by passing a plasmid DNA (or another vector DNA) through *E. coli* and other microorganisms (for example *Bacillus* spp. or yeasts such as *Saccharomyces cerevisiae*), which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromo-uracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below. Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. Dpnl site-directed mutagenesis is a further known method as described for example in the Stratagene Quickchange™ site-directed mutagenesis kit protocol. A huge number of other methods are also known and used in common practice.

Positive mutation events can be selected by screening the organisms for the production of the desired respective fine chemical.

Example 4

DNA Transfer Between *Escherichia coli* and *Corynebacterium glutamicum*

Several *Corynebacterium* and *Brevibacterium* species comprise endogenous plasmids (such as, for example, pHM1519 or pBL1) which replicate autonomously (for a review, see, for example, Martin, J. F. et al. (1987) Biotechnology 5: 137-146). Shuttle vectors for *Escherichia coli* and *Corynebacterium glutamicum* can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), which have a replication origin for, and suitable marker from, *Corynebacterium glutamicum* added. Such replication origins are preferably taken from endogenous plasmids, which have been isolated from *Corynebacterium* and *Brevibacterium* species. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim). There are many examples in the literature of the preparation of a large multiplicity of shuttle vectors which are replicated in *E. coli* and *C. glutamicum* and which can be used for various purposes including the overexpression of genes (see, for example, Yoshihama, M. et al. (1985) J. Bacteriol. 162: 591-597, Martin, J. F. et al., (1987) Biotechnology, 5: 137-146 and Eikmanns, B. J. et al. (1992) Gene 102: 93-98). Suitable vectors, which replicate in coryneform bacteria are, for example, pZ1 (Menke) et al., Appl. Environ. Microbiol., 64, 1989: 549-554) pEkEx1 (Eikmanns et al., Gene 102, 1991: 93-98) or pHS2-1 (Sonnen et al, Gene 107, 1991: 69-74). These vectors are based on the cryptic plasmids pHM1519, pBL1 or pGA1. Other plasmid vectors such as, for example, those based on pCG4 (U.S. Pat. No. 4,489,160), pNG2 (Serwold-Davis et al., FEMS Microbiol. Lett., 66, 1990: 119-124) or pAG1 (U.S. Pat. No. 5,158,891) can be used in the same manner.

Using standard methods, it is possible to clone a gene of interest into one of the above-described shuttle vectors and to introduce such hybrid vectors into *Corynebacterium glutamicum* strains. The transformation of *C. glutamicum* can be achieved by protoplast transformation (Kastsumata, R. et al., (1984) J. Bacteriol. 159, 306-311), electroporation (Liebl, E. et al., (1989) FEMS Microbiol. Letters, 53: 399-303) and in those cases where specific vectors are used also by conjugation (such as, for example, described in Schäfer, A., et al. (1990) J. Bacteriol. 172: 1663-1666). Likewise, it is possible to transfer the shuttle vectors for *C. glutamicum* to *E. coli* by preparing plasmid DNA from *C. glutamicum* (using standard methods known in the art) and transforming it into *E. coli*. This transformation step can be carried out using standard methods, but preferably using an Mcr-deficient *E. coli* strain, such as NM522 (Gough & Murray (1983) J. Mol. Biol. 166: 1-19).

If the transformed sequence(s) is/are to be integrated advantageously into the genome of the coryneform bacteria, standard techniques known to the skilled worker also exist for this purpose. Examples, which are used for this purpose are plasmid vectors as they have been described by Remscheid et al. (Appl. Environ. Microbiol., 60, 1994: 126-132) for the duplication and amplification of the hom-thrB operon. In this method, the complete gene is cloned into a plasmid vector which is capable of replication in a host such as *E. coli*, but not in *C. glutamicum*. Suitable vectors are, for example, pSUP301 (Simon et al., Bio/Technology 1, 1983: 784-791), pKlBmob or pK19mob (Schäfer et al., Gene 145, 1994: 69-73), pGEM-T (Promega Corp., Madison, Wis., USA), pCR2.1-TOPO (Schuman, J. Biol. Chem., 269, 1994: 32678-32684, U.S. Pat. No. 5,487,993), pCR® Blunt (Invitrogen, Groningen, the Netherlands) or pEM1 (Schrumpf et al., J. Bacteriol., 173, 1991: 4510-4516).

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* or other microorganisms by a variety of methods, which are known in the art, e.g. as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicates the presence and the amount of the sought mutant protein in the cell. However, other methods are also known.

Example 6

Growth of Genetically Modified *Corynebacterium glutamicum*: Media and Culture Conditions Genetically modified *Corynebacteria* are grown in synthetic or natural growth media. A number of different growth media for *Corynebacteria* are known and widely available (Lieb et al. (1989) Appl. Microbiol. Biotechnol. 32: 205-210; von der Osten et al. (1998) Biotechnology Letters 11: 11-16; Patent DE 4 120 867; Liebl (1992) "The Genus *Corynebacterium*", in: The Procaryotes, Vol. II, Balows, A., et al., Ed. Springer-Verlag).

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as $NH_4Cl$, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar and 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or NH$_4$OH. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by introducing of a preculture of seed organisms.

For example, the media are inoculated by introducing of a saline solution of *C. glutamicum* cells from CM plates or by addition of a liquid preculture of this bacterium.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N.C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 8

Analysis of the Effect of the Nucleic Acid Molecule on the Production of the Amino Acids The effect of the genetic modification in *C. glutamicum* on the production of an amino acid can be determined by growing the modified microorganisms under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Better, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 9

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 81 for the Expression in Plants

Unless otherwise specified, standard methods as described in Sambrook et al., Molecular Cloning: A laboratory manual, Cold Spring Harbor 1989, Cold Spring Harbor Laboratory Press are used.

SEQ ID NO: 81 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Pfu Turbo DNA polymerase. The amplification cycles were as follows:
1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C. The composition for the protocol of the Herculase polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Herculase polymerase. The amplification cycles were as follows:
1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID NO: 81:
 i) forward primer SEQ ID NO: 83:
 ATGTCGTCCTTATCCACTTCATTTG
 ii) reverse primer SEQ ID NO: 84:
 TTAATTGTAACGGCTATATCTACTGG Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector. The PCR-products, produced by Pfu Turbo DNA polymerase, were phosphorylated using a T4 DNA polymerase using a standard protocol (e.g. MBI Fermentas) and cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well. The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID NO: 81

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000) "A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The *agrobacteria* generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1 000 seeds per dish. The dishes were covered with a hood and placed in the stratification facility (8 h, 110μ, μmol/m$^2$/s$^{-1}$, 22° C.; 16 h, dark, 6° C.). After 5 days, the dishes were placed into the short-day controlled environment chamber (8 h 130 μmol/m$^2$/s$^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 μE, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 μl Silwett L77 (Crompton S. A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the described changes in comparison with wild-types were caused by the introduced genes.

As an alternative, the amino acids can be detected advantageously via HPLC separation in ethanolic extract as described by Geigenberger et al. (Plant Cell & Environ, 19, 1996: 43-55).

*Arabidopsis thaliana* plants were engineered as described in Example 11.

The results of the different *Arabidopsis* plants analysed can be seen from table 1 which follows:

TABLE 1

| ORF | Annotation | Metabolite | Min | Max | Methode |
|---|---|---|---|---|---|
| YFL050C | di- trivalent inorganic cation transporter | threonine | 1.193 | 1.557 | GC |
| YKR057W | ribosomal protein, similar to S21 ribosomal proteins, involved in ribosome biogenesis and translation | threonine | 1.34 | 2.413 | GC |
| YIL150C | chromatin binding protein, required for S-phase (DNA synthesis) initiation or completion | threonine | 1.256 | 4.186 | GC |
| YNL046W | probable membrane protein of the endoplasmatic reticulum | threonine | 1.178 | 1.526 | GC |
| YNL120C | not been characterized yet | threonine | 1.44 | 1.44 | LC |
| b0186 | lysine decarboxylase | threonine | 1.495 | 3.277 | GC |
| b0730 | transcriptional regulator of succinylCoA synthetase operon and fatty acyl response regulator | threonine | 1.531 | 2.772 | LC |

TABLE 1-continued

| ORF | Annotation | Metabolite | Min | Max | Methode |
|---|---|---|---|---|---|
| b1829 | defined as a heat shock protein with protease activity | threonine | 1.174 | 2.135 | GC |
| b2170 | sugar efflux transporter B | threonine | 1.359 | 1.792 | LC |
| b0019 | Na+/H+ antiporter | threonine | 1.244 | 1.44 | GC |

| Metabolite Profiling Info: | | | | |
|---|---|---|---|---|
| ORF | Metabolite | Method | Min | Max |
| b0464 | Threonine | GC | 1.23 | 1.43 |
| b1360 | Threonine | GC | 1.16 | 1.38 |
| b1738 | Threonine | LC | 1.27 | 4.61 |
| b1830 | Threonine | LC | 1.24 | 1.43 |
| b1896 | Threonine | LC + GC | 1.46 | 2.08 |
| b2414 | Threonine | GC | 1.24 | 1.46 |
| b2552 | Threonine | GC | 1.17 | 1.37 |
| b4004 | Threonine | GC | 1.17 | 1.37 |
| b2664 | Threonine | LC + GC | 1.29 | 2.84 |
| b3074 | Threonine | LC | 1.31 | 1.59 |
| b2270 | Threonine | LC | 1.31 | 1.59 |
| b3160 | Threonine | LC | 1.25 | 1.56 |
| b3231 | Threonine | GC | 1.17 | 1.32 |
| b3462 | Threonine | GC | 1.18 | 1.51 |
| b3791 | Threonine | LC | 1.38 | 1.44 |
| b3966 | Threonine | GC | 1.19 | 1.47 |
| YOR245C | Threonine | GC | 1.18 | 1.81 |

Column 3 shows the metabolite/respective fine chemical analyzed. Columns 4 and 5 shows the ratio of the analyzed metabolite/respective fine chemical between the transgenic plants and the wild type; Increase of the metabolites: Max: maximal x-fold (normalised to wild type)-Min: minimal x-fold (normalised to wild type). Decrease of the metabolites: Max: maximal x-fold (normalised to wild type) (minimal decrease), Min: minimal x-fold (normalised to wild type) (maximal decrease). Column 6 indicates the analytical method.

When the analyses were repeated independently, all results proved to be significant.

Example 14a

Engineering Ryegrass Plants by Over-Expressing the Polynucleotide Characterized in the Invention, e.g. Derived from *Saccharomyces cerevisiae*, *E. coli* or Plants or an Other Organism Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 μm in size) are coated with plasmid DNA according to method of Sanford et al., 1993 and are delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14b

Engineering Soybean Plants by Over-Expressing the Polynucleotide Characterized in the Invention, e.g. Derived from *Saccharomyces cerevisiae, E. coli* or Plants or Another Organism Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 μE–m–2 s–1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1 agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing the Polynucleotide Characterized in the Invention, e.g. Derived from *Saccharomyces cerevisiae, E. coli* or Plants or Another Organism Amplification of for example SEQ ID NO: 1 was achieved as described in example 10 except that the upstream primer SEQ ID NO:3 and the reverse primer SEQ ID NO: 4 contained the following 5"extensions:
  i) forward primer: 5"-GGGTCGCTCCTACGCG-3" SEQ ID NO: 68243
  ii) reverse primer 5"-CTCGGGCTCGGCGTCC-3" SEQ ID NO: 68246
Vector Construction The maize transformation vector for constitutive expression was constructed as follows.

As base vectors, the vectors EG073qcz (SEQ ID NO 68240) and EG065qcz (SEQ ID NO 68241) were chosen. The MCS from EG065qcz was deleted by digestion of the vector with Asp718 and PstI, followed by blunting of the vector using T4 DNA polymerase. The blunted vector was religated. The vector generated was called EG065-MCS. The LIC cassette was cloned in the vector EG065-MCS by hybridizing the following oligos, generating a DNA fragment with ends able to ligate into a SmaI and SacI digested vector. This fragment was ligated into the vector EG065-MCS that had been digested with SmaI and SacI. The generated vector was called EG065-LIC. The complete expression cassette comprising ScBV (Schenk (1999) Plant Mol Biol 39(6):1221-1230) promoter, LIC cassette and terminator was cut out of EG065-LIC with AscI and PacI and ligated into the vector EG073qcz that had previously been digested with AscI and PacI. The resulting binary vector for corn transformation was called pMME0607 (SEQ ID NO: 68242).

Oligo POCCLicMluISacIIfw: gggtcgctcctacgcgtcaatgatc-cgcggacgccgagcccgagct (SEQ ID NO: 68244)

Oligo POCCLicMluISacIrev: cgggctcggcgtccgcggatcat-tgacgcgtaggagcgaccc (SEQ ID NO: 68245)

For cloning of a polynucleotide of the invention, for example the ORF of SEQ ID NO: 1, from *S. cerevisiae* the vector DNA was treated with the restriction enzyme MluI and SacII. The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 14c.a

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of *agrobacterium* for around 30 minutes. Excised embryos were removed from liquid and then co-cultivated in the dark at 22° C. with *Agrobacterium tumefaciens* on solid MS-based callus induction medium containing 2 mg/l 2,4-D, 10 um AgNO3, and 200 um Acetosyringone. After several days of co-cultivation, embryos were transferred to MS-based media containing 2 mg/l 2,4, 10 um AgNO3 and 200 mg/l Timentin the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 uE/m2/s−1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s−1. After plants were grown to 4-6 leaf stage they were moved to 14 inch pots containing Metro-Mix® 360. Supplemental metal-halide lamps were used to maintain >800uE/m2/s−1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

Example 14c.b

Growth of T0 Corn Plants for Metabolic Analysis

Plants were grown under the following standardized conditions to properly stage them for T0 sampling. T0 plantlets were transferred to 14" pots in the greenhouse after they grow to 4-6 leaf stage (1-3 weeks). pBSMM232 containing plants were produced carried along with each experiment to serve as controls for T0 samples. Plantlets were moved to 14" pots on Tuesday of each week. Plants were grown for 9 days until the 7-13 leaf stage is reached. On Thursday between 10 am and 2 pm leaf sampling was performed on the 3rd youngest ($1^{st}$ fully elongated). Within 30 seconds 250-500 mg of leaf material (without midrib), were removed weighed and placed into pre-extracted glass thimbles in liquid nitrogen. A second sample (opposite side of the midrib) from each plant was sampled as described above for qPCR analysis.

Example 14c.c

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 7 days old, they were subjected to select transgenic plants. For this purposes pieces of plant leaves were sampled and a PCR reaction with the respective primers for the transgene were performed. Plants exhibiting the transgene were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Example 14c.d

Metabolic Analysis of Maize Leaves

The modifications identified in accordance with the invention, in the content of above-described metabolites, were identified by the following procedure.
a) Sampling and Storage of the Samples Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen. The time elapsing between cutting the leave to freezing it in liquid nitrogen amounted to not more than 30 seconds. The boxes were stored in a freezer at −80° C., an shipped on dry ice.
b) Lyophilization During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.
c) Extraction Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-decanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.
d) Processing the Lipid Phase for the LC/MS or LC/MS/MS Analysis The lipid extract, which had been evaporated to dryness was taken up in mobile phase. The HPLC was run with gradient elution.

The polar extract, which had been evaporated to dryness was taken up in mobile phase. The HPLC was run with gradient elution.
e) Derivatization of the Lipid Phase for the GC/MS Analysis For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (20 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Transformation of maize (*Zea Mays* L.) can also be performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673 can be used to provide constitutive expression of the trait gene.

Excised embryos can be grown on callus induction medium, then maize regeneration medium, containing imidazolinone as a selection agent. The Petri plates can be incubated in the light at 25° C. for 2-3 weeks, or until shoots develop. The green shoots can be transferred from each embryo to maize rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which can be PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants can exhibited similar phenotypes as the T1 plants. Hybrid plants (F1 progeny) of homozygous transgenic plants and non-transgenic plants can also exhibit increased similar phenotypes.

Example 14d

Engineering Wheat Plants by Over-Expressing the Polynucleotide Characterized in the Invention, e.g. Derived From *Saccharomyces cerevisiae*, *E. coli* or Plants or Another Organism Transformation of wheat can be performed with the method described by Ishida et al. (1996 Nature Biotech. 14745-50). The cultivar Bobwhite (available from CYMMIT, Mexico) can commonly be used in transformation. Immature embryos can be co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

After incubation with *Agrobacterium*, the embryos can be grown on callus induction medium, then regeneration medium, containing imidazolinone as a selection agent. The Petri plates can be incubated in the light at 25° C. for 2-3 weeks, or until shoots develop. The green shoots can be transferred from each embryo to rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants exhibited similar phenotypes.

Example 14e

Engineering Rapeseed/Canola Plants by Over-Expressing the Polynucleotide Characterized in the Invention, e.g. Derived From *Saccharomyces cerevisiae*, *E. coli* or Plants or Another Organism Cotyledonary petioles and hypocotyls of 5-6 day-old young seedlings can be used as explants for tissue culture and transformed according to Babic et al. (1998, Plant Cell Rep 17: 183-188). The commercial cultivar Westar (Agriculture Canada) can be the standard variety used for transformation, but other varieties can be used.

*Agrobacterium tumefaciens* LBA4404 containing a binary vector can be used for canola transformation. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

Canola seeds can be surface-sterilized in 70% ethanol for 2 min., and then in 30% Clorox with a drop of Tween-20 for 10 min, followed by three rinses with sterilized distilled water. Seeds can be then germinated in vitro 5 days on half strength MS medium without hormones, 1% sucrose, 0.7% Phytagar at 23° C., 16 hr. light. The cotyledon petiole explants with the cotyledon attached can be excised from the in vitro seedlings, and can be inoculated with *Agrobacterium* by dipping the cut end of the petiole explant into the bacterial suspension. The explants can be then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants can be transferred to MSBAP-3 medium containing 3 mg/l BAP, cefotaxime, carbenicillin, or timentin (300 mg/l) for 7 days, and can then be cultured on MSBAP-3 medium with cefotaxime, carbenicillin, or timentin and selection agent until shoot regeneration. When the shoots are 5-10 mm in length, they can be cut and transferred to shoot elongation medium (MSBAP-0.5, containing 0.5 mg/l BAP). Shoots of about 2 cm in length can be transferred to the rooting medium (MS0) for root induction.

Samples of the primary transgenic plants (T0) can be analyzed by PCR to confirm the presence of T-DNA. These results can be confirmed by Southern hybridization in which DNA is electrophoresed on a 1 agarose gel and are transferred to a positively charged nylon membrane (Roche Diagnostics). The PCR DIG Probe Synthesis Kit (Roche Diagnostics) can be used to prepare a digoxigenin-labelled probe by PCR, and used as recommended by the manufacturer.

Example 14f

Engineering Alfalfa Plants by Over-Expressing the Polynucleotide Characterized in the Invention, e.g. Derived From *Saccharomyces cerevisiae* or *E. coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) can be selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. The 34S promoter (GenBank Accession numbers M59930 and X16673) can be used to provide constitutive expression of the trait gene.

The explants can be cocultivated for 3 d in the dark on SH induction medium containing 288 mg/L Pro, 53 mg/L thioproline, 4.35 g/L K2SO4, and 100 μm acetosyringinone. The explants can be washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos can be transferred to BOi2Y development medium containing no growth regulators, no antibiotics, and 50 g/L sucrose. Somatic embryos are subsequently germinated on half-strength Murashige-Skoog medium. Rooted seedlings can be transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing the Polynucleotide Characterized in the Invention, Derived e.g. from *Saccharomyces cerevisiae*, *E. coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 15

Metabolite Profiling Info from Zea mays

*Zea mays* plants were engineered, grown and analyzed as described in Example 14c.

The results of the different *Zea mays* plants analysed can be seen from Table 2 which follows:

TABLE 2

| ORF_NAME | Metabolite | Min | Max |
|---|---|---|---|
| b1829 | Threonine | 1.44 | 1.96 |
| b2664 | Threonine | 1.77 | 3.94 |

TABLE 2-continued

| ORF_NAME | Metabolite | Min | Max |
|---|---|---|---|
| YIL150C | Threonine | 1.68 | 2.98 |
| YKR057W | Threonine | 1.59 | 5.59 |

Table 2 exhibits the metabolic data from maize, shown in either T0 or T1, describing the increase in threonine in genetically modified corn plants expressing the *Saccharomyces cerevisiae* nucleic acid sequence YIL150C or YKR057W or *E. coli* nucleic acid sequence b1829 or b2664 resp.

In one embodiment, in case the activity of the *Saccharomyces cerevisiae* protein YIL150C or its homologs, e.g. "a chromatin binding protein, required for S-phase (DNA synthesis) initiation or completion" or its homologs, is increased in corn plants, preferably, an increase of the fine chemical threonine between 68% and 198% is conferred.

In case the activity of the *Saccharomyces cerevisiae* protein YKR057W or a ribosomal protein, similar to S21 ribosomal proteins, involved in ribosome biogenesis and translation or its homolog, is increased in corn plants, preferably, an increase of the fine chemical threonine between 59% and 459%, is conferred.

In one embodiment, in case the activity of the *E. coli* protein b1829 or its homologs, e.g. "the activity of a protease is increased, preferably, the activity of a heat shock protein is increased, more preferred the activity of a htpX protein", is increased in corn plants, preferably, an increase of the fine chemical threonine between 44% and 96% is conferred.

In one embodiment, in case the activity of the *E. coli* protein b2664 or its homologs, e.g. "the activity defined as putative transcriptional repressor with DNA-binding Winged helix domain (GntR familiy)", is increased in corn plants, preferably, an increase of the fine chemical threonine between 77% and 294% is conferred.

Example 16

Preparation of Homologous Sequences from Plants

Different plants can be grown under standard or varying conditions in the greenhouse. RNA can be extracted following the protocol of Jones, Dunsmuir and Bedbrook (1985) EMBO J. 4: 2411-2418. Approx. 1 gram of tissue material from various organs is ground in liquid nitrogen. The powder is transferred to a 13 ml Falcon tube containing 4.5 ml NTES buffer (100 mM NaCl, 10 mM Tris/HCl pH 7.5, 1 mM EDTA, 1% SDS; in RNase-free water) and 3 ml phenol/chloroform/isoamylalcohol (25/24/1), immediately mixed and stored on ice. The mixture is spun for 10 minutes at 7000 rpm using a centrifuge (Sorval; SM24 or SS34 rotor). The supernatant is transferred to a new tube, ⅒th volume of 3 M NaAcetate (pH 5.2; in RNase-free water) and 1 volume of isopropanol is added, mixed at stored for 1 hour or overnight at −20° C. The mixture is spun for 10 minutes at 7000 rpm. The supernatant is discarded and the pellet washed with 70% ethanol (v/v). The mixture is spun for 5 minutes at 7000 rpm, the supernatant is discarded and the pellet is air-dried. 1 ml RNase-free water is added and allow the DNA/RNA pellet to dissolve on ice at 4 C. The nucleic acid solution is transferred to a 2 ml Eppendorf tube and 1 ml of 4 M LiAcetate is added. After mixing the solution is kept for at least 3 hours, or overnight, at 4 C. The mixture is spun for 10 minutes at 14000 rpm, the supernatant discarded, the pellet washed with 70% Ethanol, air-dried and dissolved in 200 µl of RNase-free water.

Total RNA can be used to construct a cDNA-library according to the manufacturer's protocol (for example using the ZAP-cDNA synthesis and cloning kit of Stratagene, La Jolla, USA). Basically, messenger RNA (mRNA) is primed in the first strand synthesis with a oligo(dT) linker—primer and is reverse-transcribed using reverse transcriptase. After second strand cDNA synthesis, the double-stranded cDNA is ligated into the Uni-ZAP XR vector. The Uni-ZAP XR vector allows in vivo excision of the pBluescript phagemid. The polylinker of the pBluescript phagemid has 21 unique cloning sites flanked by T3 and T7 promoters and a choice of 6 different primer sites for DNA sequencing. Systematic single run sequencing of the expected 5 prime end of the clones can allow preliminary annotation of the sequences for example with the help of the pedant pro Software package (Biomax, München). Clones for the nucleic acids of the invention or used in the process according to the invention can be identified based on homology search with standard algorithms like blastp or gap. Identified putative full length clones with identity or high homology can be subjected to further sequencing in order to obtain the complete sequence.

Additional new homologous sequences can be identified in a similar manner by preparing respective cDNA libraries from various plant sources as described above. Libraries can then be screened with available sequences of the invention under low stringency conditions for example as described in Sambrook et al., Molecular Cloning: A laboratory manual, Cold Spring Harbor 1989, Cold Spring Harbor Laboratory Press. Purified positive clones can be subjected to the in vivo excision and complete sequencing. A pairwise sequence alignment of the original and the new sequence using the blastp or gap program allows the identification of orthologs, meaning homologous sequences from different organisms, which should have a sequence identity of at least 30%. Furthermore the conservation of functionally important amino acid residues or domains, which can be identified by the alignment of several already available paralogs, can identify a new sequence as an new orthologs.

Alternatively libraries can be subjected to mass sequencing and obtained sequences can be stored in a sequence database, which then can be screened for putative orthologs by different search algorithms, for example the tbastn algorithm to search the obtained nucleic acid sequences with a amino acid sequence of the invention. Clones with the highest sequence identity are used for a complete sequence determination and orthologs can be identified as described above.

Item 1. A process for the production of threonine, which comprises
- (a) increasing or generating the activity of a protein as indicated in Table IIA or IIB, columns 5 or 7, lines 6 to 15, 339 to 355 or a functional equivalent thereof in a non-human organism, or in one or more parts thereof; and
- (b) growing the organism under conditions which permit the production of threonine in said organism.

Item 2. A process for the production of threonine, comprising the increasing or generating in an organism or a part thereof the expression of at least one nucleic acid molecule comprising a nucleic acid molecule selected from the group consisting of:
- (a) nucleic acid molecule encoding of a polypeptide as indicated in Table IIA or IIB, columns 5 or 7, lines 6 to 15, 339 to 355 or a fragment thereof, which confers an increase in the amount of threonine in an organism or a part thereof;
- (b) nucleic acid molecule comprising of the nucleic acid molecule as indicated in Table IA or IB, columns 5 or 7, lines 6 to 15, 339 to 355;
- (c) nucleic acid molecule whose sequence can be deduced from a polypeptide sequence encoded by a nucleic acid molecule of (a) or (b) as a result of the degeneracy of the genetic code and conferring an increase in the amount of threonine in an organism or a part thereof;
- (d) nucleic acid molecule which encodes a polypeptide which has at least 50% identity with the amino acid sequence of the polypeptide encoded by the nucleic acid molecule of (a) to (c) and conferring an increase in the amount of threonine in an organism or a part thereof;
- (e) nucleic acid molecule which hybidizes with a nucleic acid molecule of (a) to (c) under stringent hybridisation conditions and conferring an increase in the amount of threonine in an organism or a part thereof;
- (f) nucleic acid molecule which encompasses a nucleic acid molecule which is obtained by amplifying nucleic acid molecules from a cDNA library or a genomic library using the primers or primer pairs as indicated in Table III, columns 5 or 7, lines 6 to 15, 339 to 355 and conferring an increase in the amount of the fine chemical threonine in an organism or a part thereof;
- (g) nucleic acid molecule encoding a polypeptide which is isolated with the aid of monoclonal antibodies against a polypeptide encoded by one of the nucleic acid molecules of (a) to (f) and conferring an increase in the amount of threonine in an organism or a part thereof;
- (h) nucleic acid molecule encoding a polypeptide comprising a consensus sequence as indicated in Table IV, columns 5 or 7, lines 6 to 15, 339 to 355 and conferring an increase in the amount of the fine chemical threonine in an organism or a part thereof; and
- (i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical threonine in an organism or a part thereof.

or comprising a sequence which is complementary thereto.

Item 3. The process of item 1 or 2, comprising recovering of the free or bound threonine.

Item 4. The process of any one of item 1 to 3, comprising the following steps:
- (a) selecting an organism or a part thereof expressing a polypeptide encoded by the nucleic acid molecule characterized in item 2;
- (b) mutagenizing the selected organism or the part thereof;
- (c) comparing the activity or the expression level of said polypeptide in the mutagenized organism or the part thereof with the activity or the expression of said polypeptide of the selected organisms or the part thereof;
- (d) selecting the mutated organisms or parts thereof, which comprise an increased activity or expression level of said polypeptide compared to the selected organism or the part thereof;
- (e) optionally, growing and cultivating the organisms or the parts thereof; and
- (f) recovering, and optionally isolating, the free or bound threonine produced by the selected mutated organisms or parts thereof.

Item 5. The process of any one of items1 to 4, wherein the activity of said protein or the expression of said nucleic acid molecule is increased or generated transiently or stably.

Item 6. An isolated nucleic acid molecule comprising a nucleic acid molecule selected from the group consisting of:
  (a) nucleic acid molecule encoding a polypeptide as indicated in Table IIA or IIB, columns 5 or 7, lines 6 to 15, 339 to 355 or a fragment thereof, which confers an increase in the amount of threonine in an organism or a part thereof;
  (b) nucleic acid molecule comprising a nucleic acid as indicated in Table IA or IB, columns 5 or 7, lines 6 to 15, 339 to 355;
  (c) nucleic acid molecule whose sequence can be deduced from a polypeptide sequence encoded by a nucleic acid molecule of (a) or (b) as a result of the degeneracy of the genetic code and conferring an increase in the amount of threonine in an organism or a part thereof;
  (d) nucleic acid molecule which encodes a polypeptide which has at least 50% identity with the amino acid sequence of the polypeptide encoded by the nucleic acid molecule of (a) to (c) and conferring an increase in the amount of threonine in an organism or a part thereof;
  (e) nucleic acid molecule which hybidizes with a nucleic acid molecule of (a) to (c) under stringent hybridisation conditions and conferring an increase in the amount of threonine in an organism or a part thereof;
  (f) nucleic acid molecule which encompasses a nucleic acid molecule which is obtained by amplifying nucleic acid molecules from a cDNA library or a genomic library using the primers in Table III, column 8, lines 6 to 15, 339-355 and conferring an increase in the amount of the fine chemical threonine in an organism or a part thereof;
  (g) nucleic acid molecule encoding a polypeptide which is isolated with the aid of monoclonal antibodies against a polypeptide encoded by one of the nucleic acid molecules of (a) to (f) and conferring an increase in the amount of threonine in an organism or a part thereof;
  (h) nucleic acid molecule encoding a polypeptide comprising the consensus sequence shown in Table IV, column 8, lines 6 to 15, 339 to 355 and conferring an increase in the amount of the fine chemical in an organism or a part thereof; and
  (i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical in an organism or a part thereof.
  whereby the nucleic acid molecule distinguishes over the sequence as indicated in Table IA or IB, columns 5 or 7, lines 6 to 15, 339 to 355 by one or more nucleotides.

Item 7. A nucleic acid construct which confers the expression of the nucleic acid molecule of item 6, comprising one or more regulatory elements.

Item 8. A vector comprising the nucleic acid molecule as defined in item 6 or the nucleic acid construct of item 7.

Item 9. The vector as defined in item 8, wherein the nucleic acid molecule is in operable linkage with regulatory sequences for the expression in a prokaryotic or eukaryotic, or in a prokaryotic and eukaryotic, host.

Item 10. A host cell, which has been transformed stably or transiently with the vector as defined in item or 10 or the nucleic acid molecule as defined in item 6 or the nucleic acid construct of item 7 or produced as described in item any one of items 2 to 5.

Item 11. The host cell of item 10, which is a transgenic host cell.

Item 12. The host cell of item 10 or 11, which is a plant cell, an animal cell, a microorganism, or a yeast cell, a fungus cell, a prokaryotic cell, an eukaryotic cell or an archaebacterium.

Item 13. A process for producing a polypeptide, wherein the polypeptide is expressed in a host cell as defined in any one of items 10 to 12.

Item 14. A polypeptide produced by the process as defined in item 13 or encoded by the nucleic acid molecule as defined in item 6 whereby the polypeptide distinguishes over a Sequence as indicated in Table IIA or IIB, columns 5 or 7, lines 6 to 15, 339 to 355 by one or more amino acids Item 15. An antibody, which binds specifically to the polypeptide as defined in item 14.

Item 16. A plant tissue, propagation material, harvested material or a plant comprising the host cell as defined in item 12 which is plant cell or an *Agrobacterium*.

Item 17. A method for screening for agonists and antagonists of the activity of a polypeptide encoded by the nucleic acid molecule of item 6 conferring an increase in the amount of threonine in an organism or a part thereof comprising:
  (a) contacting cells, tissues, plants or microorganisms which express the a polypeptide encoded by the nucleic acid molecule of item 6 conferring an increase in the amount of threonine in an organism or a part thereof with a candidate compound or a sample comprising a plurality of compounds under conditions which permit the expression the polypeptide;
  (b) assaying the threonine level or the polypeptide expression level in the cell, tissue, plant or microorganism or the media the cell, tissue, plant or microorganisms is cultured or maintained in; and
  (c) identifying a agonist or antagonist by comparing the measured threonine level or polypeptide expression level with a standard threonine or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Item 18. A process for the identification of a compound conferring increased threonine production in a plant or microorganism, comprising the steps:
  (a) culturing a plant cell or tissue or microorganism or maintaining a plant expressing the polypeptide encoded by the nucleic acid molecule of item 6 conferring an increase in the amount of threonine in an organism or a part thereof and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of item 6 conferring an increase in the amount of threonine in an organism or a part thereof;
(b) identifying if the compound is an effective agonist by detecting the presence or absence or increase of a signal produced by said readout system.

Item 19. A method for the identification of a gene product conferring an increase in threonine production in a cell, comprising the following steps:
(a) contacting the nucleic acid molecules of a sample, which can contain a candidate gene encoding a gene product conferring an increase in threonine after expression with the nucleic acid molecule of item 6;
(b) identifying the nucleic acid molecules, which hybridise under relaxed stringent conditions with the nucleic acid molecule of item 6;
(c) introducing the candidate nucleic acid molecules in host cells appropriate for producing threonine;
(d) expressing the identified nucleic acid molecules in the host cells;
(e) assaying the threonine level in the host cells; and
(f) identifying nucleic acid molecule and its gene product which expression confers an increase in the threonine level in the host cell after expression compared to the wild type.

Item 20. A method for the identification of a gene product conferring an increase in threonine production in a cell, comprising the following steps:
(a) identifiying in a data bank nucleic acid molecules of an organism; which can contain a candidate gene encoding a gene product conferring an increase in the threonine amount or level in an organism or a part thereof after expression, and which are at least 20% homolog to the nucleic acid molecule of item 6;
(b) introducing the candidate nucleic acid molecules in host cells appropriate for producing threonine;
(c) expressing the identified nucleic acid molecules in the host cells;
(d) assaying the threonine level in the host cells; and
(e) identifying the nucleic acid molecule and its gene product which expression confers an increase in the threonine level in the host cell after expression compared to the wild type.

Item 21. A method for the production of an agricultural composition comprising the steps of the method of any one of items 17 to 20 and formulating the compound identified in any one of items 17 to 20 in a form acceptable for an application in agriculture.

Item 22. A composition comprising the nucleic acid molecule of item 6, the polypeptide of item 14, the nucleic acid construct of item 7, the vector of any one of items 8 or 9, an antagonist or agonist identified according to item 17, the compound of item 18, the gene product of item 19 or 20, the antibody of item 15, and optionally an agricultural acceptable carrier.

Item 23. Use of the nucleic acid molecule as defined in item 6 for the identification of a nucleic acid molecule conferring an increase of threonine after expression.

Item 24. Use of the polypeptide of item 14 or the nucleic acid construct item 7 or the gene product identified according to the method of item 19 or 20 for identifying compounds capable of conferring a modulation of threonine levels in an organism.

Item 25. Food or feed composition comprising the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 16, the host cell of item 10 to 12 or the gene product identified according to the method of item 19 or 20.

The present invention relates to a process for the production of the fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

In a further embodiment, the present invention relates to a further process for the production of fine chemicals as defined below and corresponding embodiments as described herein as follows.

The present invention relates to a process for the production of a fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other substances described in Ullmann's Encyclopedia of Industrial Chemistry, vol. A2, pp. 57-97, VCH Weinheim, 1985.

Over one million tons of amino acids are currently produced annually; their market value amounts to over 2.5 billion US dollars. They are currently produced by four competing processes: Extraction from protein hydrolysates, for example L-cystine, L-leucine or L-tyrosine, chemical synthesis, for example of D-, L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is *Corynebacterium glutamicum*, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterized thoroughly; for a review of the bacterial amino acid biosynthesis and its regulation, see Umbarger, H. E. (1978) Ann. Rev. Biochem. 47: 533-606.

It is known that amino acids are produced by fermentation of strains of coryneform bacteria, in particular *Corynebacte-* rium glutamicum. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as Escherichia or Bacillus are also used for the production of amino acids. A number of mutant strains, which produce an assortment of desirable compounds from the group of the sulfur-containing fine chemicals, have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetyl-norleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082,993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases special enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenesis of plant and selection afterwards with inhibitors of certain enzymes of amino acid biosynthetic pathway.

Methods of recombinant DNA technology have also been used for some years to improve Corynebacterium strains producing L-amino acids by amplifying individual amino acid biosynthesis genes and investigating the effect on amino acid production.

As described above, the essential amino acids are necessary for humans and many mammals, for example for livestock. L-methionine is important as methyl group donor for the biosynthesis of, for example, choline, creatine, adrenaline, bases and RNA and DNA, histidine, and for the transmethylation following the formation of S-adenosyl-methionine or as a sulfhydryl group donor for the formation of cysteine. Moreover, L-methionine appears to have a positive effect in depression.

As described above, the essential amino acids are necessary for humans and many mammals, for example for livestock. Tryptophane (L-tryptophane) is one of the most reactive amino acids. At pH 4.0-6.0 tryptophane amino group reacts with aldehydes producing Schiff-bases. On the other hand if the amino group is blocked by acetylation, tryptophane reacts with aldehydes yielding carboline derivatives (carboline 1,2,3,4-tetrahydro-carboline-3-carboxylic acid). Tryptophane plays a unique role in defense against infection because of its relative scarcity compared to other amino acids. During infection, the body induces tryptophane-catabolizing enzymes which increase tryptophane's scarcity in an attempt to starve the infecting organisms [R. R. Brown, Y. Ozaki, S. P. Datta, et al., Implications of interferon-induced tryptophane catabolism in cancer, auto-immune diseases and AIDS. In: Kynurenine and Serotonin Pathways, R. Schwarcz, et al., (Eds.), Plenum Press, New York, 1991]. In most proteins, tryptophane is the least abundant essential amino acid, comprising approximately 1% of plant proteins and 1.5% of animal proteins. Although the minimum daily requirement for tryptophane is 160 mg for women and 250 mg for men, 500-700 mg are recommended to ensure high-quality protein intake. Actual tryptophane utilization is substantially higher. Men use approximately 3.5 grams of tryptophane to make one days's worth of protein [J. C. Peters, Tryptophane Nutrition and Metabolism: an Overview. In: Kynurenine and Serotonin Pathways, R. Schwarcz, et al., (Eds.), Plenum Press, New York, 1991]. The balance is obtained by hepatic recycling of tryptophane from used (catabolized) proteins.

Dietary tryptophane is well absorbed intestinally. About 10% of the tryptophane circulating in the bloodstream is free, and 90% is bound to the protein albumin. The tryptophane binding site on albumin also has affinity for free fatty acids (FFAs), so tryptophane is displaced when FFAs rise, as when fasting.

Although tryptophane is not usually the limiting amino acid in protein synthesis, tryptophane may become insufficient for the normal functioning of other tryptophane-dependent pathways. Numerous lines of research point to tryptophane's central role in regulation of feeding and other behaviors. Tryptophane is not only typically the least abundant amino acid in the livers free amino acid pool, but liver tryptophane-tRNA levels fall faster during food deprivation than other indispensable amino acids [Q. R. Rogers, The nutritional and metabolic effects of amino acid imbalances. In: Protein Metabolism and Nutrition, D. J. A. Cole (Ed.), Butterworths, London, 1976]. Under fasting conditions, and possibly in wasting syndromes, tryptophane may become the rate-limiting amino acid for protein synthesis [Peters, 1991].

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add a plurality of amino acids in a balanced manner to suit the organism.

It is an object of the present invention to develop an inexpensive process for the synthesis of tryptophane, preferably L-tryptophane. Tryptophane is together with methionine, lysine and threonine (depending on the organism) one of the amino acids which are most frequently limiting.

It was now found that this object is achieved by providing the process according to the invention described herein and the embodiments characterized in the claims.

Accordingly, in a first embodiment, the invention relates to a process for the production of a fine chemical, whereby the fine chemical is tryptophan, preferably L-tryptophane. Accordingly, in the present invention, the term "the fine chemical" as used herein relates to "tryptophane". Further, the term "the fine chemicals" as used herein also relates to fine chemicals comprising tryptophan.

In one embodiment, the term "the fine chemical" means tryptophane, preferably L-tryptophane. Throughout the specification the term "the fine chemical" means tryptophane, preferably L-tryptophane, its salts, ester or amids in free form or bound to proteins. In a preferred embodiment, the term "the fine chemical" means tryptophane, preferably L-tryptophane, in free form or its salts or bound to proteins.

In one embodiment, the term "the fine chemical" and the term "the respective fine chemical" mean at least one chemical compound with an activity of the above mentioned fine chemical.

Accordingly, the present invention relates to a process comprising
(a) increasing or generating the activity of one or more YER173W, YGR104c, b0186, b0161, b0486, b1318, b2270, b3074, b3983 and/or YHR189W—protein(s) or of a protein having the sequence of a polypeptide encoded by a nucleic acid molecule indicated in Table I, columns 5 or 7, lines 16 to 18 and/or lines 356 to 362 in a non-human organism in one or more parts thereof and
(b) growing the organism under conditions which permit the production of the fine chemical, thus, tryptophane or fine chemicals comprising tryptophane, in said organism.

Accordingly, the present invention relates to a process for the production of a fine chemical comprising
(a) increasing or generating the activity of one or more proteins having the activity of a protein indicated in Table II, column 3, lines 16 to 18 and/or lines 356 to 362 or having the sequence of a polypeptide encoded by a nucleic acid molecule indicated in Table I, column 5 or 7, lines 16 to 18 and/or lines 356 to 362, in a non-human organism in one or more parts thereof and
(b) growing the organism under conditions which permit the production of the fine chemical, in particular tryptophane.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

The term "Table I" used in this specification is to be taken to specify the content of Table I A and Table I B. The term "Table II" used in this specification is to be taken to specify the content of Table II A and Table II B. The term "Table I A" used in this specification is to be taken to specify the content of Table I A. The term "Table I B" used in this specification is to be taken to specify the content of Table I B. The term "Table II A" used in this specification is to be taken to specify the content of Table II A. The term "Table II B" used in this specification is to be taken to specify the content of Table II B.
In one preferred embodiment, the term "Table I" means Table I B. In one preferred embodiment, the term "Table II" means Table II B.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein having the activity of a protein indicated in Table II, column 3, lines 16 to 18 and/or lines 356 to 362 or encoded by nucleic acid molecule indicated in Table I, columns 5 or 7, lines 16 to 18 and/or lines 356 to 362.

Surprisingly it was found, that the transgenic expression of at least one of the *Saccaromyces* cerevisiae protein(s) indicated in Table II, Column 3, lines 16 to 17 and/or 362 and/or at least one of the *Escherichia coli* K12 proteins indicated in Table II, Column 3, line 18 and/or lines 356 to 361 in *Arabidopsis thaliana* conferred an increase in the threonine (or fine chemical) content of the transformed plants.

In accordance with the invention, the term "organism" as understood herein relates always to a non-human organism, in particular to an animal or plant organism or to a microorganism. Further, the term "animal" as understood herein relates always to a non-human animal.

In accordance with the invention it is known to the skilled that anionic compounds such as acids are present in aqueous solutions in an equilibrium between the acid and its salts according to the pH present in the respective compartment of the cell or organism and the pK of the acid. Depending on the strength of the acid (pK) and the pH the salt or the free acid are predominant. Thus, the term "the fine chemical", the term "the respective fine chemical", or the term "acid" or the use of a denomination referring to a neutralized anionic compound relates to the anionic form as well as the neutralised status of that compound according to the milieu of the aqueous solution in which they are present.

The sequence of YER173W from *Saccharomyces cerevisiae* has been published in Dietrich, Nature 387 (6632 Suppl), 78-81, 1997, and Goffeau, Science 274 (5287), 546-547, 1996, and its activity is beeing defined as an "Checkpoint protein, involved in the activation of the DNA damage and meiotic pachytene checkpoints; subunit of a clamp loader that loads Rad17p-Mec3p-Dc1p onto DNA, homolog of the human and *S. pompe* Rad17 protein; Rad24p". Accordingly, in one embodiment, the process of the present invention comprises the use of a "Checkpoint protein, involved in the activation of the DNA damage and meiotic pachytene checkpoints" or its "subunit of a clamp loader that loads Rad17p-Mec3p-Dc1p onto DNA" or a Rad24p from *Saccaromyces cerevisiae* or a Rad17 protein or its homolog, e.g. as shown herein, for the production of the fine chemical, meaning of tryptophane, in particular for increasing the amount of tryptophane in free or bound form in an organism or a part thereof, as mentioned.

The sequence of YGR104c from *Saccharomyces cerevisiae* has been published in Thompson et al., Cell 73:1361-1375, 1993, and its activity is beeing defined as an "RNA polymerase II suppressor protein SRB5-yeast". Accordingly, in one embodiment, the process of the present invention comprises the use of a "RNA polymerase II suppressor protein (SRB5—yeast)" or its homolog, for the production of the fine chemical, meaning of tryptophane, in particular for increasing the amount of tryptophane in free or bound form in an organism or a part thereof, as mentioned.

The sequence of b0186 from *Escherichia coli* K12 has been published in Blattner et al., Science 277(5331), 1453-1474, 1997, and its activity is beeing defined as a lysine decarboxylase. Accordingly, in one embodiment, the process of the present invention comprises the use of a lysine decarboxylase from *E. coli* or its homolog, e.g. as shown herein, for the production of the fine chemical, meaning of tryptophane, in particular for increasing the amount of tryptophane, preferably tryptophane in free or bound form in an organism or a part thereof, as mentioned. In one embodiment, in the process of the present invention the activity of a lysine decarboxylase is increased or generated, e.g. from *E. coli* or a homolog thereof.

The sequence of b0161 from *Escherichia coli* K12 has been published in Blattner et al., Science 277(5331), 1453-1474, 1997, and its activity is beeing defined as a periplasmic serine protease (heat shock protein). Accordingly, in one embodiment, the process of the present invention comprises the use of a gene product with an activity of the *helicobacter* serine proteinase superfamily, preferably a protein with a periplasmic serine protease (heat shock protein) activity or its homolog, e.g. as shown herein, from *Escherichia coli* K12 or its homolog, e.g. as shown herein, for the production of the fine chemical, meaning of tryptophane in free or bound form in an organism or a part thereof, as mentioned.

The sequence of b0486 from *Escherichia coli* K12 has been published in Blattner, Science 277(5331), 1453-1474, 1997, and its activity is beeing defined as a amino-acid/amine transport protein (of the APC family). Accordingly, in one embodiment, the process of the present invention comprises the use of a gene product with the activity of the membrane protein ybaT superfamily, preferably a protein with a amino-acid/amine transport protein (of the APC family) activity from *E. coli* or its homolog, e.g. as shown herein, for the production of the fine chemical, meaning of tryptophane, in particular for increasing the amount of tryptophane in free or bound form in an organism or a part thereof, as mentioned.

The sequence of b1318 from *Escherichia coli* K12 has been published in Blattner, Science 277(5331), 1453-1474, 1997, and its activity is beeing defined as a sugar transport protein (of the ABC superfamily). Accordingly, in one embodiment, the process of the present invention comprises the use of a gene product with the activity of the inner membrane protein malK (with ATP-binding cassette homology) superfamily, preferably a protein with a sugar transport protein (of the ABC superfamily) activity from *E. coli* or its homolog, e.g. as shown herein, for the production of the fine chemical, meaning of tryptophane, in particular for increasing the amount of tryptophane in free or bound form in an organism or a part thereof, as mentioned.

The sequence of b2270 from *Escherichia coli* K12 has been published in Blattner et al., Science 277(5331), 1453-1474, 1997, and its activity has not been characterized yet. Accordingly, in one embodiment, the process of the present invention comprises the use of a protein b2270 from *E. coli* or its homolog, e.g. as shown herein, for the production of the fine chemical, meaning of tryptophane, in particular for increasing the amount of tryptophane in free or bound form in an organism or a part thereof, as mentioned.

The sequence of b3074 from *Escherichia coli* K12 has been published in Blattner et al., Science 277(5331), 1453-1474, 1997, and its activity is being defined as a tRNA synthetase. Accordingly, in one embodiment, the process of the present invention comprises the use of a gene product with the activity of the secretion chaperone CsaA and/or methionyl-tRNA synthetase (dimer-forming) superfamily, preferably a protein with a tRNA synthetase activity from *E. coli* or its homolog, e.g. as shown herein, for the production of the fine chemical, meaning of tryptophane, in particular for increasing the amount of tryptophane in free or bound form in an organism or a part thereof, as mentioned.

The sequence of b3983 from *Escherichia coli* K12 has been published in Blattner et al., Science 277(5331), 1453-1474, 1997, and its activity is being defined as a 50S ribosomal subunit protein L12. Accordingly, in one embodiment, the process of the present invention comprises the use of a gene product with the activity of the *Escherichia coli* ribosomal protein L11 superfamily, preferably a protein with a 50S ribosomal subunit protein L12 activity from *E. coli* or its homolog, e.g. as shown herein, for the production of the fine chemical, meaning of tryptophane, in particular for increasing the amount of tryptophane in free or bound form in an organism or a part thereof, as mentioned.

The sequence of YHR189W from *Saccharomyces cerevisiae* has been published in and Goffeau, Science 274 (5287), 546-547, 1996 and Johnston, Nature 387 (6632 Suppl), 87-90, 1997, and its activity is beeing defined as a peptidyl-tRNA hydrolase. Accordingly, in one embodiment, the process of the present invention comprises the use of a gene product with the activity of the peptidyl-tRNA hydrolase superfamily, preferably a protein with at peptidyl-tRNA hydrolase activity from *Saccharomyces cerevisiae* or its homolog, e.g. as shown herein, for the production of the fine chemical, meaning of tryptophane, in particular for increasing the amount of tryptophane in free or bound form in an organism or a part thereof, as mentioned.

Homologues (=homologs) of the present gene products can be derived from any organisms as long as the homologue confers the herein mentioned activity, in particular, confers an increase in the fine chemical amount or content. Further, in the present invention, the term "homologue" relates to the sequence of an organism having the highest sequence homology to the herein mentioned or listed sequences of all expressed sequences of said organism.

However, the person skilled in the art knows, that, preferably, the homologue has said the—fine-chemical-increasing activity and, if known, the same biological function or activity in the organism as at least one of the protein(s) indicated in Table I, Column 3, lines 16 to 18 and/or lines 356 to 362, e.g.

having the sequence of a polypeptide encoded by a nucleic acid molecule comprising the sequence indicated in indicated in Table I, Column 5 or 7, lines 16 to 18 and/or lines 356 to 362.

In one embodiment, the homolog of any one of the polypeptides indicated in Table II, lines 16 to 17 and/or line 362 is a homolog having the same or a similar activity, in particular an increase of activity confers an increase in the content of the fine chemical in the organsims and being derived from an Eukaryot. In one embodiment, the homolog of a polypeptide indicated in Table II, column 3, line 18 and/or lines 356 to 361 is a homolog having the same or a similar activity, in particular an increase of activity confers an increase in the content of the fine chemical in the organisms or part thereof, and being derived from bacteria. In one embodiment, the homolog of a polypeptide indicated in Table II, column 3, lines 16 to 17 and/or line 362 is a homolog having the same or a similar activity, in particular an increase of activity confers an increase in the content of the fine chemical in an organisms or part thereof, and being derived from Fungi. In one embodiment, the homolog of a polypeptide indicated in Table II, column 3, line 18 and/or lines 356 to 361 is a homolog having the same or a similar activity, in particular an increase of activity confers an increase in the content of the fine chemical in the organsims or part thereof and being derived from Proteobacteria. In one embodiment, the homolog of a polypeptide indicated in Table II, column 3, lines 16 to 17 and/or line 362 is a homolog having the same or a similar activity, in particular an increase of activity confers an increase in the content of the fine chemical in the organsims or a part thereof and being derived from Ascomycota. In one embodiment, the homolog of a polypeptide indicated in Table II, column 3, line 18 and/or lines 356 to 361 is a homolog having the same or a similar activity, in particular an increase of activity confers an increase in the content of the fine chemical in the organisms or part thereof, and being derived from Gammaproteobacteria. In one embodiment, the homolog of a polypeptide polypeptide indicated in Table II, column 3, lines 16 to 17 and/or line 362 is a homolog having the same or a similar activity, in particular an increase of activity confers an increase in the content of the fine chemical in the organisms or part thereof, and being derived from Saccharomycotina. In one embodiment, the homolog of a polypeptide indicated in Table II, column 3, line 18 and/or lines 356 to 361 is a homolog having the same or a similar activity, in particular an increase of activity confers an increase in the content of the fine chemical in the organisms or part thereof, and being derived from Enterobacteriales. In one embodiment, the homolog of a polypeptide indicated in Table II, column 3, lines 16 to 17 and/or line 362 is a homolog having the same or a similar activity, in particular an increase of activity confers an increase in the content of the fine chemical in the organisms or a part thereof, and being derived from Saccharomycetes. In one embodiment, the homolog of the a polypeptide indicated in Table II, column 3, line 18 and/or lines 356 to 361 is a homolog having the same or a similar activity, in particular an increase of activity confers an increase in the content of the fine chemical in the organisms or part thereof, and being derived from Enterobacteriaceae. In one embodiment, the homolog of a polypeptide indicated in Table II, column 3, lines 16 to 17 and/or line 362 is a homolog having the same or a similar activity, in particular an increase of activity confers an increase in the content of the fine chemical in the organisms, and being derived from Saccharomycetales. In one embodiment, the homolog of a polypeptide indicated in Table II, column 3, line 18 and/or line 356 to 361 is a homolog having the same or a similar activity, in particular an increase of activity confers an increase in the content of the fine chemical in the organisms or a part thereof, and being derived from Escherichia. In one embodiment, the homolog of a polypeptide indicated in Table II, column 3, lines 16 to 17 and/or line 362 is a homolog having the same or a similar activity, in particular an increase of activity confers an increase in the content of the fine chemical in the organisms or a part thereof, and being derived from Saccharomycetaceae. In one embodiment, the homolog of a polypeptide indicated in Table II, column 3, line 16 to 17 and/or line 362 is a homolog having the same or a similar activity, in particular an increase of activity confers an increase in the content of the fine chemical in the organisms or a part thereof, and being derived from Saccharomycetes.

Homologs of the polypeptides indicated in Table II, column 3, lines 16 to 17 and/or line 362 may be the polypetides encoded by the nucleic acid molecules polypeptide indicated in Table I, column 7, lines 16 to 17 and/or line 362 or may be the polypeptides indicated in Table II, column 7, lines 16 to 17 and/or line 362. Homologs of the polypeptides polypeptide indicated in Table II, column 3, line 18 and/or lines 356 to 361 may be the polypetides encoded by the nucleic acid molecules polypeptide indicated in Table I, column 7, lines 18 and/or lines 356 to 361 or may be the polypeptides indicated in Table II, column 7, lines 18 and/or lines 356 to 361.

Further homologs of are described herein below.

In accordance with the invention, a protein or polypeptide has the "activity of an protein of the invention", e.g. the activity of a protein indicated in Table II, column 3, lines 16 to 18 and/or lines 356 to 362 if its de novo activity, or its increased expression directly or indirectly leads to an increased tryptophane level in the organism or a part thereof, preferably in a cell of said organism. In a preferred embodiment, the protein or polypeptide has the above-mentioned additional activities of a protein indicated in Table II, column 3, lines 16 to 18 and/or lines 356 to 362. Throughout the specification the activity or preferably the biological activity of such a protein or polypeptide or an nucleic acid molecule or sequence encoding such protein or polypeptide is identical or similar if it still has the biological or enzymatic activity of any one of the proteins indicated in Table II, column 3, lines 16 to 18 and/or lines 356 to 362, i.e. or which has at least 10% of the original enzymatic activity, preferably 20%, particularly preferably 30%, most particularly preferably 40% in comparison to an any one of the proteins indicated in Table II, column 3, lines 16 to 17 and/or line 362 of *Saccharomyces* and/or any one of the proteins indicated in Table II, column 3, line 18 and/or lines 356 to 361 of *E. coli* K12.

In one embodiment, the polypeptide of the invention or the polypeptide used in the method of the invention confers said activity, e.g. the increase of the fine chemical in an organism or a part thereof, if it is derived from an organism, which is evolutionary distant to the organism in which it is expressed. For example origin and expressing organism are derived from different families, orders, classes or phylums.

In one embodiment, the polypeptide of the invention or the polypeptide used in the method of the invention confers said activity, e.g. the increase of the fine chemical in an organism or a part thereof, if it is derived from an organism, which is evolutionary close to the organism indicated in Table I, column 4 and is expressed in an organism, which is evolutionary distant to the origin organism. For example origin and expressing organism are derived from different families, orders, classes or phylums whereas origin and the organism indicated in Table I, column 4 are derived from the same families, orders, classes or phylums.

The terms "increased", "rose", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change or the modulation of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild type cell. However, the terms increase or decrease as used herein also include the change or modulation of a property in the whole organism as mentioned.

Accordingly, the term "increase" or "decrease" means that the specific activity of an enzyme, preferably the amount of a compound or metabolite, e.g. of a polypeptide, a nucleic acid molecule or of the respective fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control, or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control, or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention or the polypeptide used in the method of the invention, e.g. as result of an increase in the level of the nucleic acid molecule of the present invention or an increase of the specific activity of the polypeptide of the invention or the polypeptide used in the method of the invention. E.g., it differs by or in the expression level or activity of an protein having the activity of a protein as indicated in Table II, column 3, lines 16 to 18 and/or lines 356 to 362 or being encoded by a nucleic acid molecule indicated in Table I, column 5, lines 16 to 18 and/or lines 356 to 362 or its homologs, e.g. as indicated in Table I, column 7, lines 16 to 18 and/or lines 356 to 362, its biochemical or genetical causes and therefore shows the increased amount of the fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of a protein, e.g. the polypeptide of the invention or the polypeptide used in the method of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by amplifying the number of gene(s), by modifying the regulation of the gene, or by increasing the stability of the corresponding mRNA or of the corresponding gene product encoded by the nucleic acid molecule of the invention or the nucleic acid molecule used in the method of the invention, or by introducing homologous genes from other organisms which are differently regulated, e.g. not feedback sensitive.

This also applies analogously to the combined increased expression of the nucleic acid molecule of the present invention or its gene product with that of further enzymes or regulators of the biosynthesis pathways of the respective fine chemical, e.g. which are useful for the synthesis of the respective fine chemicals.

The increase, decrease or modulation according to this invention can be constitutive, e.g. due to a stable permanent transgenic expression or to a stable mutation in the corresponding endogenous gene encoding the nucleic acid molecule of the invention or the nucleic acid molecule used in the method of the invention or to a modulation of the expression or of the behaviour of a gene conferring the expression of the polypeptide of the invention or the polypeptide used in the method of the invention, or transient, e.g. due to an transient transformation or temporary addition of a modulator such as a agonist or antagonist or inducible, e.g. after transformation with a inducible construct carrying the nucleic acid molecule of the invention or the nucleic acid molecule used in the method of the invention under control of a inducible promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the respective fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In case the activity of the *Saccaromyces* cerevisiae protein YER173W or its homologs, e.g. a checkpoint protein, involved in the activation of the DNA damage and meiotic pachytene checkpoints; subunit of a clamp loader that loads Rad17p-Mec3p-Ddc1p onto DNA or Rad24p or its homologs, e.g. the human or *S. pombe* Rad17, e.g. as indicated in Table I, columns 5 or 7, line 16 is increased, preferably, an increase of the fine chemical between 27% and 178% or more is conferred.

In case the activity of the *Saccaromyces* cerevisiae protein YGR104c or its homologs, e.g. a RNA polymerase II suppressor protein (SRB5—yeast) e.g. as indicated in Table I, columns 5 or 7, line 17 is increased, preferably, an increase of the fine chemical between 32% and 84% or more is conferred. (s.o.)

In case the activity of the *Escherichia coli* K12 protein b0186 or a lysine decarboxylase or its homologs, e.g. as indicated in Table I, columns 5 or 7, line 18 is increased, preferably, an increase of the fine chemical between 32% and 146% is conferred. S.o.

In case the activity of the *Escherichia coli* K12 protein b0161 or its homologs, e.g. the activity of a protein of the *Helicobacter* serine proteinase superfamily is increased, preferably, of a protein having a periplasmic serine protease (heat shock protein) activity, e.g. as indicated in Table I, columns 5 or 7, line 356, is increased conferring an increase of the respective fine chemical, preferably tryptophane between 93% and 278% or more.

In case the activity of the *Escherichia coli* K12 protein b0486 or its homologs, e.g. the activity of a protein of the membrane protein ybaT superfamily, preferably a protein with a amino-acid/amine transport protein (of the APC family) activity, e.g. as indicated in Table I, columns 5 or 7, line 357, is increased conferring an increase of the respective fine chemical, preferably tryptophane between 42% and 335% or more.

In case the activity of the *Escherichia coli* K12 protein b1318 or its homologs, e.g. the activity of the inner membrane protein malK (with ATP-binding cassette homology) superfamily, preferably a protein with a sugar transport protein (of the ABC superfamily) activity, e.g. as indicated in Table I, columns 5 or 7, line 358, is increased conferring an increase of the respective fine chemical, preferably tryptophane between 136% and 330% or more.

In case the activity of the *Escherichia coli* K12 protein b2270 or its homologs, e.g. the activity of a b2270 protein of *E. coli*, e.g. as indicated in Table I, columns 5 or 7, line 359, is increased conferring an increase of the respective fine chemical, preferably tryptophane between 33% and 79% or more.

In case the activity of the *Escherichia coli* K12 protein b3074 or its homologs, e.g. the activity of a protein of the secretion chaperone CsaA and/or methionyl-tRNA synthetase (dimer-forming) superfamily, preferably a protein with a tRNA synthetase activity, e.g. as indicated in Table I, columns 5 or 7, line 360, is increased conferring an increase of the respective fine chemical, preferably tryptophane between 33% and 79% or more.

In case the activity of the *Escherichia coli* K12 protein b3983 or its homologs, e.g. the activity of a *Escherichia coli* ribosomal protein L11 superfamily, preferably a protein with a 50S ribosomal subunit protein L12 activity, e.g. as indicated in Table I, columns 5 or 7, line 361, is increased conferring an increase of the respective fine chemical, preferably tryptophane between 33% and 387% or more.

In case the activity of the *Saccaromyces* cerevisiae protein YHR189W or its homologs, e.g. the activity of a peptidyl-tRNA hydrolase superfamily, preferably a protein with a peptidyl-tRNA hydrolase activity, e.g. as indicated in Table I, columns 5 or 7, line 362, is increased conferring an increase of the respective fine chemical, preferably tryptophane between 31% and 66% or more.

In one embodiment, in case the activity of the *Saccaromyces* cerevisiae protein YER173W or its homologs, e.g. a checkpoint protein, involved in the activation of the DNA damage and meiotic pychtene checkpoints; subunit of a clamp loader that loads Rad17p-Mec3p-Ddc1p onto DNA or or Rad24p or its homologs, e.g. the human or *S. pombe* Rad17, e.g. as indicated in Table I, columns 5 or 7, line 16, is increased, preferably, an increase of the fine chemical and of proline is conferred.

In one embodiment, in case the activity of the *Saccaromyces* cerevisiae protein YGR104c or its homologs, e.g. a RNA polymerase II suppressor protein (SRB5—yeast), e.g. as indicated in Table I, columns 5 or 7, line 17, is increased, preferably, an increase of the fine chemical and glutamic acid is conferred.

In one embodiment, in case the activity of the *Escherichia coli* K12 protein b0186 or its homologs, e.g. a lysine decarboxylase or its homologs,e.g. as indicated in Table I, columns 5 or 7, line 18, is increased preferably, an increase of the fine chemical and of methionine is conferred.

In one embodiment, in case the activity of the *Escherichia coli* K12 protein b0161 or its homologs is increased, e.g. the activity of a protein of the *Helicobacter* serine proteinase superfamily is increased, preferably, of a protein having a periplasmic serine protease (heat shock protein) activity, e.g. as indicated in Table I, columns 5 or 7, line 356, is increased an increase of the respective fine chemical, preferably of tryptophane and of further amino acid(s) is conferred.

In one embodiment, in case the activity of the *Escherichia coli* K12 protein b0486 or its homologs is increased, e.g. the activity of a protein of the membrane protein ybaT superfamily, preferably a protein with a amino-acid/amine transport protein (of the APC family) activity, e.g. as indicated in Table I, columns 5 or 7, line 357, is increased an increase of the respective fine chemical, preferably of tryptophane and of further amino acid(s) is conferred.

In one embodiment, in case the activity of the *Escherichia coli* K12 protein b1318 or its homologs is increased, e.g. the activity of the inner membrane protein malK (with ATP-binding cassette homology) superfamily, preferably a protein with a sugar transport protein (of the ABC superfamily) activity, e.g. as indicated in Table I, columns 5 or 7, line 358, is increased an increase of the respective fine chemical, preferably of tryptophane and of further amino acid(s) is conferred.

In one embodiment, in case the activity of the *Escherichia coli* K12 protein b2270 or its homologs is increased, e.g. the activity of a transcriptional regulator, is increased, e.g. as indicated in Table I, columns 5 or 7, line 359, is increased an increase of the respective fine chemical, preferably of tryptophane and of further amino acid(s) is conferred.

In one embodiment, in case the activity of the *Escherichia coli* K12 protein b3074 or its homologs is increased, e.g. the activity of a tRNA synthetase or its homologs, e.g. transcriptional regulator, e.g. as indicated in Table I, columns 5 or 7, line 360, is increased an increase of the respective fine chemical, preferably of tryptophane and of further amino acid(s) is conferred.

In one embodiment, in case the activity of the *Escherichia coli* K12 protein b3983 or its homologs is increased, e.g. the activity of a *Escherichia coli* ribosomal protein L11 superfamily, preferably a protein with a 50S ribosomal subunit protein L12 activity, e.g. as indicated in Table I, columns 5 or 7, line 361, is increased an increase of the respective fine chemical, preferably of tryptophane and of further amino acid(s) is conferred.

In one embodiment, in case the activity of the *Saccaromyces* cerevisiae protein YHR189W or its homologs is increased, e.g. the activity of a peptidyl-tRNA hydrolase superfamily, preferably a protein witha peptidyl-tRNA hydrolase activity, e.g. as indicated in Table I, columns 5 or 7, line 362, is increased an increase of the respective fine chemical, preferably of tryptophane and of further amino acid(s) is conferred.

In this context, the respective fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The respective fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the respective fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of the fine chemical preferably has the structure of the polypeptide described herein, in particular of a polypeptides comprising a consensus sequence as indicated in Table IV, columns 7, lines 16 to 18 and/or lines 356 to 362 or of a polypeptide as indicated in Table II, columns 5 or 7, lines 16 to 18 and/or lines 356 to 362 or the functional homologues thereof as described herein, or is encoded by the nucleic acid molecule characterized herein or the nucleic acid molecule according to the invention, for example by a nucleic acid molecule as indicated in Table I, columns 5 or 7, lines 16 to 18 and/or lines 356 to 362 or its herein described functional homologues and has the herein mentioned activity.

For the purposes of the present invention, the term "tryptophane" and "L-tryptophane" also encompass the corresponding salts, such as, for example, tryptophane hydrochloride or tryptophane sulfate. Preferably the term tryptophane is intended to encompass the term L-tryptophane.

Owing to the biological activity of the proteins which are used in the process according to the invention and which are encoded by nucleic acid molecules according to the invention, it is possible to produce compositions comprising the respective fine chemical, i.e. an increased amount of the free chemical free or bound, e.g. fine chemical compositions. Depending on the choice of the organism used for the process according to the present invention, for example a microorganism or a plant, compositions or mixtures of various fine chemicals, e.g. comprising further distinct amino acids, fatty acids, vitamins, hormones, sugars, lipids, etc. can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps (a) stabilizing a protein conferring the increased expression of a protein encoded by the nucleic acid molecule of the invention or of the polypeptide of the invention or the nucleic acid molecule or the polypeptide used in the method of the invention, e.g. of a polypeptide having an activity of a protein as indicated in Table II, column 3, lines 16 to 18 and/or lines 356 to 362 or its homologs activity, e.g. as indicated in Table II, columns 5 or 7, lines 16 to 18 and/or lines 356 to 362, having herein-mentioned the fine chemical-increasing activity;

(b) stabilizing a mRNA conferring the increased expression of a protein encoded by the nucleic acid molecule of the invention or the nucleic acid molecule used in the method of the invention, e.g. of a polypeptide having an activity of a protein as indicated in Table II, column 3, lines 16 to 18 and/or lines 356 to 362 or its homologs activity, e.g. as indicated in Table II, columns 5 or 7, lines 16 to 18 and/or lines 356 to 362, or of a mRNA encoding the polypeptide of the present invention having herein-mentioned tryptophane increasing activity;

(c) increasing the specific activity of a protein conferring the increased expression of a protein encoded by the nucleic acid molecule of the invention or of the polypeptide of the present invention or the polypeptide used in the method of the invention having herein-mentioned tryptophane increasing activity, e.g. of a polypeptide having an activity of a protein as indicated in Table II, column 3, lines 16 to 18 and/or lines 356 to 362 or its homologs activity, e.g. as indicated in Table II, columns 5 or 7, lines 16 to 18 and/or lines 356 to 362, or decreasing the inhibitiory regulation of the polypeptide of the invention or the polypeptide used in the method of the invention;

(d) generating or increasing the expression of an endogenous or artificial transcription factor mediating the expression of a protein conferring the increased expression of a protein encoded by the nucleic acid molecule of the invention or the nucleic acid molecule used in the method of the invention or of the polypeptide of the invention or the polypeptide used in the method of the invention having herein-mentioned tryptophane increasing activity, e.g. of a polypeptide having an activity of a protein as indicated in Table II, column 3, lines 16 to 18 and/or lines 356 to 362, or its homologs activity, e.g. as indicated in Table II, columns 5 or 7, lines 16 to 18 and/or lines 356 to 362;

(e) stimulating activity of a protein conferring the increased expression of a protein encoded by the nucleic acid molecule of the present invention or a polypeptide of the present invention having herein-mentioned tryptophane increasing activity, e.g. of a polypeptide having an activity of a protein as indicated in Table II, column 3, lines 16 to 18 and/or lines 356 to 362, or its homologs activity, e.g. as indicated in Table II, columns 5 or 7, lines 16 to 18 and/or lines 356 to 362, by adding one or more exogenous inducing factors to the organismus or parts thereof;

(f) expressing a transgenic gene encoding a protein conferring the increased expression of a polypeptide encoded by the nucleic acid molecule of the present invention or a polypeptide of the present invention, having herein-mentioned tryptophane increasing activity, e.g. of a polypeptide having an activity of a protein as indicated in Table II, column 3, lines 16 to 18 and/or lines 356 to 362, or its homologs activity, e.g. as indicated in Table II, columns 5 or 7, lines 16 to 18 and/or lines 356 to 362;

(g) increasing the copy number of a gene conferring the increased expression of a nucleic acid molecule encoding a polypeptide encoded by the nucleic acid molecule of the invention or the nucleic acid molecule used in the method of the invention or the polypeptide of the invention or the polypeptide used in the method of the invention having herein-mentioned tryptophane increasing activity, e.g. of a polypeptide having an activity of a protein as indicated in Table II, column 3, lines 16 to 18 and/or lines 356 to 362, or its homologs activity, e.g. as indicated in Table II, columns 5 or 7, lines 16 to 18 and/or lines 356 to 362;

(h) Increasing the expression of the endogenous gene encoding the polypeptide of the invention or the polypeptide used in the method of the invention, e.g. a polypeptide having an activity of a protein as indicated in Table II, column 3, lines 16 to 18 and/or lines 356 to 362, or its homologs activity, e.g. as indicated in Table II, columns 5 or 7, lines 16 to 18 and/or lines 356 to 362, copy by adding positive expression or removing negative expression elements; e.g. homologous recombination can be used to either introduce positive regulatory elements like for plants the 35S enhancer into the promoter or to remove repressor elements form regulatory regions. Further gene conversion methods can be used to disrupt repressor elements or to enhance to activty of positive elements. Positive elements can be randomly introduced in plants by T-DNA or transposon mutagenesis and lines can be identified in which the positive elements have be integrated near to a gene of the invention, the expression of which is thereby enhanced;

(i) Modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced the fine chemical production; and/or (j) selecting of organisms with expecially high activity of the proteins of the invention from natural or from mutagenized resources and breeding them into the target organisms, eg the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring the increase of tryptophane after increasing the expression or activity of the encoded polypeptide or having the activity of a polypeptide having an activity of a protein as indicated in Table II, columns 5 or 7, lines 16 to 18 and/or lines 356 to 362 or its homologs activity, e.g. as indicated in Table II, columns 5 or 7, lines 16 to 18 and/or lines 356 to 362.

In general, the amount of mRNA or polypeptide in a cell or a compartment of a organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention or the polypeptide used in the method of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell, or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, a organ, an organelle etc., is achieved by increasing the endogenous level of the polypeptide of the invention or the polypeptide used in the method of the invention. Accordingly, in an embodiment of the present invention, the present invention relates to a process wherein the gene copy number of a gene encoding the polynucleotide or nucleic acid molecule of the invention or the nucleic acid molecule used in the method of the invention as herein described is increased. Further, the endogenous level of the polypeptide of the invention or the polypeptide used in the method of the invention as described can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others citied therein. Reverse genetic strategies to identify insertions (which eventually carrying the activation elements) near in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques:

The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as tilling (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, of the polypeptide of the invention or the polypeptide used in the method of the invention, e.g. conferring the increase of the respective fine chemical after increase of expression or activity can also be increased by introducing a synthetic transcription factor, which binds close to the coding region of an endogenous polypeptide of the invention or the polypeptide used in the method of the invention- or used in the process of the invention or its endogenous homolog-encoding gene and the synthetic transcription factor activates its transcription. A chimeric zinc finger protein can be construed, which comprises a specific DNA-binding domain and an activation domain as e.g. the VP16 domain of Herpes Simplex virus. The specific binding domain can bind to the regulatory region of the endogenous protein coding region. The expression of the chimeric transcription factor in a organism, in particular in a plant, leads to a specific expression of an endogenous polypeptide of the invention or used in the process of the invention, in particular a plant homolog thereof, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It is therefore advantageously to express in an organism a nucleic acid molecule of the invention or the nucleic acid molecule used in the method of the invention or a polypeptide of the invention or the polypeptide used in the method of the invention derived from a evolutionary distantly related organism, as e.g. using a prokaryotic gene in an eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired respective fine chemical(s).

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below, into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) respective fine chemicals, in particular amino acids, likewise the fine chemical.

Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids or its precursors, required for the cell's biosynthesis of amino acids may be increased so that the concentration of necessary or relevant precursors, cofactors or intermediates within the cell(s) or within the corresponding storage compartments is increased. Owing to the increased or novel generated activity of the polypeptide of the invention or the polypeptide used in the method of the invention or owing to the increased number of nucleic acid sequences of the invention and/or to the modulation of further genes which are involved in the biosynthesis of the amino acids, e.g. by increasing the activity of enzymes synthesizing precursors or by destroying the activity of one or more genes which are involved in the breakdown of the amino acids, it is possible to increase the yield, production and/or production efficiency of amino acids in the host organism, such as the plants or the microorganisms.

By influencing the metabolism thus, it is possible to produce, in the process according to the invention, further advantageous compounds. Examples of such compounds are, in addition to tryptophane chorismic acid, anthralinic acid, N-5'-Phosphoribosyl-anthranilate, 1-(o-Carboxyphenylamino)-1-deoxyribulose 5-phosphate., 1-(Indol-3-yl)-glycerin-3-phosphate, and 5-hydroxytrytophane.

Accordingly, in one embodiment, the process according to the invention relates to a process which comprises:
providing a non-human organism, preferably a microorganism, a non-human animal, a plant or animal cell, a plant or animal tissue or a plant;
(a) increasing an activity of a polypeptide of the invention or the polypeptide used in the method of the invention or a homolog thereof, e.g. as indicated in Table II, columns 5 or 7, lines 16 to 18 and/or lines 356 to 362, or of a polypeptide being encoded by the nucleic acid molecule of the present invention and described below, e.g. conferring an increase of the respective fine chemical in the organism, preferably in a microorganism, a non-human animal, a plant or animal cell, a plant or animal tissue or a plant,
(b) growing the organism, preferably the microorganism, the non-human animal, the plant or animal cell, the plant or animal tissue or the plant under conditions which permit the production of the respective fine chemical in the organism, preferably the microorganism, the plant cell, the plant tissue or the plant; and
(c) if desired, recovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the fine chemical but as option it is also possible to produce, recover and, if desired isolate, other free or/and bound amino acids, in particular lysine. Galili et al., Transgenic Res., 200, 9, 2, 137-144 describes that the heterologous expression of a bacterial gene for the amino acid biosynthesis confers the increase of free as well as of protein-bound amino acids.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the respective fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the respective fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae Tuberculariaceae, Adelotheciaceae, Dinophyceae, Ditrichaceae or Prasinophyceae, or a prokaryotic organism, for example a bacterium or blue alga, in particular a bacterium from the families Actinomycetaceae, Bacillaceae, Brevibacteriaceae, Corynebacteriaceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The microorganisms or the recovered, and if desired isolated, respective fine chemical can then be processed further directly into foodstuffs or animal feeds or for other applications, for example according to the disclosures made in EP-B-0 533 039 or EP-A-0 615 693, which are expressly incorporated herein by reference. The fermentation broth or fermentation products can be purified in the customary manner by extraction and precipitation or via ion exchangers and other methods known to the person skilled in the art and described herein below. Products of these different work-up procedures are amino acids or amino acid compositions which still comprise fermentation broth and cell components in different amounts, advantageously in the range of from 0 to 99% by weight, preferably below 80% by weight, especially preferably between below 50% by weight.

Preferred microorganisms are selected from the group consisting of Chaetomiaceae such as the genera *Chaetomium* e.g. the species *Chaetomidium fimeti*; Choanephoraceae such as the genera *Blakeslea, Choanephora* e.g. the species *Blakeslea trispora, Choanephora cucurbitarum* or *Choanephora infundibulifera* var. *cucurbitarum*; Cryptococcaceae such as the genera *Candida, Crytococcus, Rhodotorula, Torulopsis* e.g. the species *Candida albicans, Candida albomarginata, Candida antarctica, Candida bacarum, Candida bogoriensis, Candida boidinii, Candida bovina, Candida brumptii, Candida cacaoi, Candida cariosilignicola, Candida catenulata, Candida chalmersii, Candida ciferrii, Candida cylindracea, Candida edax, Candida emobii, Candida famata, Candida freyschussii, Candida friedrichii, Candida glabrata, Candida guilliermondii, Candida haemulonii, Candida humicola, Candida inconspicua, Candida ingens, Candida intermedia, Candida kefyr, Candida krusei, Candida lactiscondensi, Candida lambica, Candida lipolytica, Candida lusitaniae, Candida macedoniensis, Candida magnoliae, Candida membranaefaciens, Candida mesenterica, Candida multigemmis, Candida mycoderma, Candida nemodendra, Candida nitratophila, Candida norvegensis, Candida norvegica, Candida parapsilosis, Candida pelliculosa, Candida peltata, Candida pini, Candida pseudotropicalis, Candida pulcherrima, Candida punicea, Candida pustula, Candida ravautii, Candida reukaufii, Candida rugosa, Candida sake, Candida silvicola, Candida solani, Candida* sp., *Candida spandovensis, Candida succiphila, Candida tropicalis, Candida utilis, Candida valida, Candida versatilis, Candida vini, Candida zeylanoides, Cryptococcus albidus, Cryptococcus curvatus, Cryptococcus flavus, Cryptococcus humicola, Cryptococcus hungaricus, Cryptococcus kuetzingii, Crypto-* coccus laurentii, Cryptococcus macerans, Cryptococcus neoformans, Cryptococcus terreus, Cryptococcus uniguttulatus, Rhodotorula acheniorum, Rhodotorula bacarum, Rhodotorula bogoriensis, Rhodotorula flava, Rhodotorula glutinis, Rhodotorula macerans, Rhodotorula minuta, Rhodotorula mucilaginosa, Rhodotorula pilimanae, Rhodotorula pustula, Rhodotorula rubra, Rhodotorula tokyoensis, Torulopsis colliculosa, Torulopsis dattila or Torulopsis neoformans; Cunninghamellaceae such as the genera Cunninghamella e.g. the species Cunninghamella blakesleeana, Cunninghamella echinulata, Cunninghamella echinulata var. elegans, Cunninghamella elegans or Cunninghamella homothaffica; Demetiaceae such as the genera Alternaria, Bipolaris, Cercospora, Chalara, Cladosporium, Curvularia, Exophilia, Helicosporium, Helminthosporium, Orbimyces, Philalophora, Pithomyces, Spilocaea, Thielaviopsis, Wangiella e.g. the species Curvularia affinis, Curvularia clavata, Curvularia fallax, Curvularia inaequalis, Curvularia indica, Curvularia lunata, Curvularia pallescens, Curvularia verruculosa or Helminothosporium sp.; Moniliaceae such as the genera Arthrobotrys, Aspergillus, Epidermophyton, Geotrichum, Gliocladium, Histoplasma, Microsporum, Monilia, Oedocephalum, Oidium, Penicillium, Trichoderma, Trichophyton, Thrichoteclum, Verticillium e.g. the species Aspergillus aculeatus, Aspergillus albus, Aspergillus alliaceus, Aspergillus asperescens, Aspergillus awamori, Aspergillus candidus, Aspergillus carbonarius, Aspergillus carneus, Aspergillus chevalieri, Aspergillus chevalieri var. intermedius, Aspergillus clavatus, Aspergillus ficuum, Aspergillus flavipes, Aspergillus flavus, Aspergillus foetidus, Aspergillus fumigatus, Aspergillus giganteus, Aspergillus humicola, Aspergillus intermedius, Aspergillus japonicus, Aspergillus nidulans, Aspergillus niger, Aspergillus niveus, Aspergillus ochraceus, Aspergillus oryzae, Aspergillus ostianus, Aspergillus parasiticus, Aspergillus parasiticus var. globosus, Aspergillus penicillioides, Aspergillus phoenicis, Aspergillus rugulosus, Aspergillus sclerotiorum, Aspergillus sojae var. gymnosardae, Aspergillus sydowi, Aspergillus tamarii, Aspergillus terreus, Aspergillus terricola, Aspergillus toxicarius, Aspergillus unguis, Aspergillus ustus, Aspergillus versicolor, Aspergillus vitricolae, Aspergillus wentii, •Penicillium adametzi, •Penicillium albicans, Penicillium arabicum, Penicillium arenicola, Penicillium argillaceum, Penicillium arvense, Penicillium asperosporum, •Penicillium aurantiogriseum, •Penicillium avellaneum, •Penicillium baarnense, •Penicillium baciffisporum, •Penicillium brasilianum, •Penicillium brevicompactum, •Penicillium camemberti, •Penicillium canadense, •Penicillium canescens, •Penicillium caperatum, •Penicillium capsulatum, •Penicillium caseicolum, •Penicillium chrysogenum, •Penicillium citreonigrum, •Penicillium citrinum, •Penicillium claviforme, •Penicillium commune, •Penicillium corylophilum, •Penicillium corymbiferum, •Penicillium crustosum, •Penicillium cyclopium, •Penicillium daleae, •Penicillium decumbens, •Penicillium dierckxii, •Penicillium digitatum, •Penicillium digitatum var. latum, •Penicillium divaricatum, •Penicillium diversum, •Penicillium duclauxii, •Penicillium echinosporum, •Penicillium expansum, •Penicillium fellutanum, •Penicillium frequentans, •Penicillium funiculosum, •Penicillium glabrum, •Penicillium gladioli, •Penicillium griseofulvum, •Penicillium hirsutum, •Penicillium hispanicum, •Penicillium islandicum, •Penicillium italicum, •Penicillium italicum var. avellaneum, •Penicillium janczewskii, •Penicillium janthinellum, •Penicillium japonicum, •Penicillium lavendulum, •Penicillium lilacinum, •Penicillium lividum, •Penicillium martensii, •Penicillium megasporum, •Penicillium miczynskii, •Penicillium nalgiovense, •Penicillium nigricans, •Penicillium notatum, •Penicillium ochrochloron, •Penicillium odoratum, •Penicillium oxalicum, •Penicillium paraherquei, •Penicillium patulum, •Penicillium pinophilum, •Penicillium piscarium, •Penicillium pseudostromaticum, •Penicillium puberulum, •Penicillium purpurogenum, •Penicillium raciborskii, •Penicillium roqueforti, •Penicillium rotundum, •Penicillium rubrum, •Penicillium sacculum, •Penicillium simplicissimum, •Penicillium sp., Penicillium spinulosum, Penicillium steckii, Penicillium stoloniferum, Penicillium striatisporum, Penicillium striatum, Penicillium tardum, Penicillium thomii, Penicillium turbatum, Penicillium variabile, Penicillium vermiculatum, Penicillium vermoesenii, Penicillium verrucosum, Penicillium verrucosum var. corymbiferum, Penicillium verrucosum var. cyclopium, Penicillium verruculosum, Penicillium vinaceum, Penicillium violaceum, Penicillium viridicatum, Penicillium vulpinum, Trichoderma hamatum, Trichoderma harzianum, Trichoderma koningii, Trichoderma longibrachiatum, Trichoderma polysporum, Trichoderma reesei, Trichoderma virens or Trichoderma viride; Mortierellaceae such as the genera Mortierella e.g. the species Mortierella isabeffina, Mortierella polycephala, Mortierella ramanniana, Mortierella vinacea or Mortierella zonata; Mucoraceae such as the genera Actinomucor, Mucor, Phycomyces, Rhizopus, Zygorhynchus e.g. the species Mucor amphibiorum, Mucor circinelloides f. circinelloides, Mucor circinelloides var. griseocyanus, Mucor flavus, Mucor fuscus, Mucor griseocyanus, Mucor heterosporus, Mucor hiemalis, Mucor hiemalis f. hiemalis, Mucor inaequisporus, Mucor indicus, Mucor javanicus, Mucor mucedo, Mucor mucilagineus, Mucor piriformis, Mucor plasmaticus, Mucor plumbeus, Mucor racemosus, Mucor racemosus f. racemosus, Mucor racemosus f. sphaerosporus, Mucor rouxianus, Mucor rouxii, Mucor sinensis, Mucor sp., Mucor spinosus, Mucor tuberculisporus, Mucor variisporus, Mucor variosporus, Mucor wosnessenskii, Phycomyces blakesleeanus, Rhizopus achlamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus var. chinensis, Rhizopus microsporus var. oligosporus, Rhizopus microsporus var. rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici or Rhizopus usamii; Pythiaceae such as the genera Phytium, Phytophthora e.g. the species Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae var. parasitica, Phytophthora palmivora, Phytophthora parasitica or Phytophthora syringae; Sacharomycetaceae such as the genera Hansenula, Pichia, Saccharomyces, Saccharomycodes, Yarrowia e.g. the species Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii,

*Pichia cellobiosa, Pichia ciferrii, Pichia farinosa, Pichia fermentans, Pichia finlandica, Pichia glucozyma, Pichia guiffiermondii, Pichia haplophila, Pichia henricii, Pichia holstii, Pichia jadinii, Pichia lindnerii, Pichia membranaefaciens, Pichia methanolica, Pichia minuta* var. *minuta, Pichia minuta* var. *nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces baffii, Saccharomyces bayanus, Saccharomyces bisporus, Saccharomyces capensis, Saccharomyces carlsbergensis, Saccharomyces cerevisiae, Saccharomyces cerevisiae* var. *ellipsoideus, Saccharomyces chevalieri, Saccharomyces delbrueckii, Saccharomyces diastaticus, Saccharomyces drosophilarum, Saccharomyces elegans, Saccharomyces ellipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii* or *Yarrowia lipolytica*; Saprolegniaceae such as the genera *Saprolegnia* e.g. the species *Saprolegnia ferax*; Schizosacharomycetaceae such as the genera *Schizosaccharomyces* e.g. the species *Schizosaccharomyces japonicus* var. *japonicus, Schizosaccharomyces japonicus* var. *versatilis, Schizosaccharomyces malidevorans, Schizosaccharomyces octosporus, Schizosaccharomyces pombe* var. *malidevorans* or *Schizosaccharomyces pombe* var. *pombe*; Sodariaceae such as the genera *Neurospora, Sordaria* e.g. the species *Neurospora africana, Neurospora crassa, Neurospora intermedia, Neurospora sitophila, Neurospora tetrasperma, Sordaria fimicola* or *Sordaria macrospora*; Tuberculariaceae such as the genera *Epicoccum, Fusarium, Myrothecium, Sphacelia, Starkeyomyces, Tubercularia* e.g. the species *Fusarium acuminatum, Fusarium anthophilum, Fusarium aquaeductuum, Fusarium aquaeductuum* var. *medium, Fusarium avenaceum, Fusarium buharicum, Fusarium camptoceras, Fusarium cerealis, Fusarium chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusarium equiseti* var. *bullatum, Fusarium eumartii, Fusarium flocciferum, Fusarium fujikuroi, Fusarium graminearum, Fusarium graminum, Fusarium heterosporum, Fusarium incarnatum, Fusarium inflexum, Fusarium javanicum, Fusarium lateritium, Fusarium lateritium* var. *majus, Fusarium longipes, Fusarium melanochlorum, Fusarium merismoides, Fusarium merismoides* var. *chlamydosporale, Fusarium moniliforme, Fusarium moniliforme* var. *anthophilum, Fusarium moniliforme* var. *subglutinans, Fusarium nivale, Fusarium nivale* var. *majus, Fusarium oxysporum, Fusarium oxysporum* f. sp. *aechmeae, Fusarium oxysporum* f. sp. *cepae, Fusarium oxysporum* f. sp. *conglutinans, Fusarium oxysporum* f. sp. *cucumerinum, Fusarium oxysporum* f. sp. *cyclaminis, Fusarium oxysporum* f. sp. *dianthi, Fusarium oxysporum* f. sp. *lycopersici, Fusarium oxysporum* f. sp. *melonis, Fusarium oxysporum* f. sp. *passiflorae, Fusarium oxysporum* f. sp. *pisi, Fusarium oxysporum* f. sp. *tracheiphilum, Fusarium oxysporum* f. sp. *tuberosi, Fusarium oxysporum* f. sp. *tulipae, Fusarium oxysporum* f. sp. *vasinfectum, Fusarium pallidoroseum, Fusarium poae, Fusarium proliferatum, Fusarium proliferatum* var. *minus, Fusarium redolens, Fusarium redolens* f. sp. *dianthi, Fusarium reticulatum, Fusarium roseum, Fusarium sacchari* var. *elongatum, Fusarium sambucinum, Fusarium sambucinum* var. *coeruleum, Fusarium semitectum, Fusarium semitectum* var. *majus, Fusarium solani, Fusarium solani* f. sp. *pisi, Fusarium sporotrichioides, Fusarium sporotrichioides* var. *minus, Fusarium sublunatum, Fusarium succisae, Fusarium sulphureum, Fusarium tabacinum, Fusarium tricinctum, Fusarium udum, Fusarium ventricosum, Fusarium verticiffioides, Fusarium xylarioides* or *Fusarium zonatum*; Sporobolomycetaceae such as the genera *Bullera, Sporobolomyces, Itersonilia* e.g. the species *Sporobolomyces holsaticus, Sporobolomyces odorus, Sporobolomyces puniceus, Sporobolomyces salmonicolor, Sporobolomyces singularis* or *Sporobolomyces tsugae*; Adelotheciaceae such as the genera e.g. the species *Physcomitrella patens*; Dinophyceae such as the genera *Crypthecodinium, Phaeodactylum* e.g. the species *Crypthecodinium cohnii* or *Phaeodactylum tricornutum*; Ditrichaceae such as the genera *Ceratodon, Pleuridium, Astomiopsis, Ditrichum, Philibertiella, Ceratodon, Distichium, Skottsbergia* e.g. the species *Ceratodon antarcticus, Ceratodon purpureus, Ceratodon purpureus* ssp. *convolutes* or *Ceratodon purpureus* ssp. *stenocarpus*; Prasinophyceae such as the genera *Nephroselmis, Prasinococcus, Scherffelia, Tetraselmis, Mantoniella, Ostreococcus* e.g. the species *Nephroselmis olivacea, Prasinococcus capsulatus, Scherffelia dubia, Tetraselmis chui, Tetraselmis suecica, Mantoniella squamata* or *Ostreococcus tauri*; Actinomycetaceae such as the genera *Actinomyces, Actinobaculum, Arcanobacterium, Mobiluncus* e.g. the species *Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii* subsp. *anitratus, Actinomyces neuii* subsp. *neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii* subsp. *curtisii, Mobiluncus curtisii* subsp. *holmesii* or *Mobiluncus mulieris*; Bacillaceae such as the genera *Amphibacillus, Anoxybacillus, Bacillus, Exiguobacterium, Gracilibacillus, Holobacillus, Saccharococcus, Salibacillus, Virgibacillus* e.g. the species *Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius, Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borste-*

*lensis, Bacillus brevis, Bacillus carboniphilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus* subsp. *fusiformis, Bacillus galactophilus, Bacillus globisporus, Bacillus globisporus* subsp. *marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquariensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis* subsp. *spizizenii, Bacillus subtilis* subsp. *subtilis, Bacillus thermantarcticus, Bacillus thermoaerophilus, Bacillus thermoamylovorans, Bacillus thermoantarcticus, Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetyllcum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus truepefi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii* or *Virgibacillus salexigens*, Brevibacteriaceae such as the genera *Brevibacterium* e.g. the species *Brevibacterium acetylicum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum* or *Brevibacterium vitaeruminis*; Corynebacteriaceae such as the genera *Corynebacterium* e.g. the species *Corynebacterium accolens, Corynebacterium afermentans* subsp. *afermentans, Corynebacterium afermentans* subsp. *lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium ilicis, Corynebacterium imitans, Corynebacterium insidiosum, Corynebacterium iranicum, Corynebacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacterium michiganense* subsp. *tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis* or *Corynebacterium xerosis*; Enterobacteriacae such as the genera *Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingella, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia* and *Yokenella* e.g. the species *Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izardii, Buttiauxella noackiae, Buttiauxella warmboldiae, Cedecea davisae, Cedecea lapagei, Cedecea neteri, Citrobacter amalonaticus, Citro-* bacter diversus, Citrobacter freundii, Citrobacter genomospecies, Citrobacter gillenii, Citrobacter intermedium, Citrobacter koseri, Citrobacter murliniae, Citrobacter sp., Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora subsp. atroseptica, Erwinia carotovora subsp. betavasculorum, Erwinia carotovora subsp. odorifera, Erwinia carotovora subsp. wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxylata, Escherichia anindolica, Escherichia aurescens, Escherichia blattae, Escherichia coli, Escherichia coli var. communior, Escherichia coli-mutabile, Escherichia fergusonii, Escherichia hermannii, Escherichia sp., Escherichia vulneris, Ewingella americana, Hafnia alvei, Klebsiella aerogenes, Klebsiella edwardsii subsp. atlantae, Klebsiella ornithinolytica, Klebsiella oxytoca, Klebsiella planticola, Klebsiella pneumoniae, Klebsiella pneumoniae subsp. pneumoniae, Klebsiella sp., Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera sp., Leclercia adecarboxylata, Leminorella grimontii, Leminorella richardii, Moellerella wisconsensis, Morganella morganii, Morganella morganii subsp. morganii, Morganella morganii subsp. Obesumbaterium proteus, Pantoea agglomerans, Pantoea ananatis, Pantoea citrea, Pantoea dispersa, Pantoea punctata, Pantoea stewartii subsp. stewartii, Pantoea terrea, Pectobacterium atrosepticum, Pectobacterium carotovorum subsp. atrosepticum, Pectobacterium carotovorum subsp. carotovorum, Pectobacterium chrysanthemi, Pectobacterium cypripedii, Photorhabdus asymbiotica, Photorhabdus luminescens, Photorhabdus luminescens subsp. akhurstii, Photorhabdus luminescens subsp. laumondii, Photorhabdus luminescens subsp. luminescens, Photorhabdus sp., Photorhabdus temperata, Plesiomonas shigelloides, Pragia fontium, Proteus hauseri, Proteus ichthyosmius, Proteus inconstans, Proteus mirabilis, Proteus morganii, Proteus myxofaciens, Proteus penneri, Proteus rettgeri, Proteus shigelloides, Proteus vulgaris, Providencia alcalifaciens, Providencia friedericiana, Providencia heimbachae, Providencia rettgeri, Providencia rustigianii, Providencia stuartii, Rahnella aquatilis, Salmonella abony, Salmonella arizonae, Salmonella bongori, Salmonella choleraesuis subsp. arizonae, Salmonella choleraesuis subsp. bongori, Salmonella choleraesuis subsp. cholereasuis, Salmonella choleraesuis subsp. diarizonae, Salmonella choleraesuis subsp. houtenae, Salmonella choleraesuis subsp. indica, Salmonella choleraesuis subsp. salamae, Salmonella daressalaam, Salmonella enterica subsp. houtenae, Salmonella enterica subsp. salamae, Salmonella enteritidis, Salmonella gallinarum, Salmonella heidelberg, Salmonella panama, Salmonella senftenberg, Salmonella typhimurium, Serratia entomophila, Serratia ficaria, Serratia fonticola, Serratia grimesii, Serratia liquefaciens, Serratia marcescens, Serratia marcescens subsp. marcescens, Serratia marinorubra, Serratia odorifera, Serratia plymouthensis, Serratia plymuthica, Serratia proteamaculans, Serratia proteamaculans subsp. quinovora, Serratia quinivorans, Serratia rubidaea, Shigella boydii, Shigella flexneri, Shigella paradysenteriae, Shigella sonnei, Tatumella ptyseos, Xenorhabdus beddingii, Xenorhabdus bovienii, Xenorhabdus luminescens, Xenorhabdus nematophila, Xenorhabdus nematophila subsp. beddingii, Xenorhabdus nematophila subsp. bovienii, Xenorhabdus nematophila subsp. poinarii or Xenorhabdus poinarii; Gordoniaceae such as the genera Gordonia, Skermania e.g. the species Gordonia aichiensis, Gordonia alkanivorans, Gordonia amarae, Gordonia amicalis, Gordonia bronchialis, Gordonia desulfuricans, Gordonia hirsuta, Gordonia hydrophobica, Gordonia namibiensis, Gordonia nitida, Gordonia paraffinivorans, Gordonia polyisoprenivorans, Gordonia rhizosphera, Gordonia rubripertincta, Gordonia sihwensis, Gordonia sinesedis, Gordonia sputi, Gordonia terrae or Gordonia westfalica; Micrococcaceae such as the genera Micrococcus, Arthrobacter, Kocuria, Nesterenkonia, Renibacterium, Rothia, Stomatococcus e.g. the species Micrococcus agilis, Micrococcus antarcticus, Micrococcus halobius, Micrococcus kristinae, Micrococcus luteus, Micrococcus lylae, Micrococcus nishinomiyaensis, Micrococcus roseus, Micrococcus sedentarius, Micrococcus varians, Arthrobacter agilis, Arthrobacter albus, Arthrobacter atrocyaneus, Arthrobacter aurescens, Arthrobacter chlorophenolicus, Arthrobacter citreus, Arthrobacter creatinolyticus, Arthrobacter crystallopoietes, Arthrobacter cumminsii, Arthrobacter duodecadis, Arthrobacter flavescens, Arthrobacter flavus, Arthrobacter gandavensis, Arthrobacter globiformis, Arthrobacter histidinolovorans, Arthrobacter ilicis, Arthrobacter koreensis, Arthrobacter luteolus, Arthrobacter methylotrophus, Arthrobacter mysorens, Arthrobacter nasiphocae, Arthrobacter nicotianae, Arthrobacter nicotinovorans, Arthrobacter oxydans, Arthrobacter pascens, Arthrobacter picolinophilus, Arthrobacter polychromogenes, Arthrobacter protophormiae, Arthrobacter psychrolactophilus, Arthrobacter radiotolerans, Arthrobacter ramosus, Arthrobacter rhombi, Arthrobacter roseus, Arthrobacter siderocapsulatus, Arthrobacter simplex, Arthrobacter sulfonivorans, Arthrobacter sulfureus, Arthrobacter terregens, Arthrobacter tumescens, Arthrobacter uratoxydans, Arthrobacter ureafaciens, Arthrobacter variabilis, Arthrobacter viscosus, Arthrobacter woluwensis, Kocuria erythromyxa, Kocuria kristinae, Kocuria palustris, Kocuria polaris, Kocuria rhizophila, Kocuria rosea, Kocuria varians, Nesterenkonia halobia, Nesterenkonia lacusekhoensis, Renibacterium salmoninarum, Rothia amarae, Rothia dentocariosa, Rothia mucilaginosa, Rothia nasimurium or Stomatococcus mucilaginosus; Mycobacteriaceae such as the genera Mycobacterium e.g. the species Mycobacterium africanum, Mycobacterium agri, Mycobacterium aichiense, Mycobacterium alvei, Mycobacterium asiaticum, Mycobacterium aurum, Mycobacterium austroafricanum, Mycobacterium bohemicum, Mycobacterium botniense, Mycobacterium brumae, Mycobacterium chelonae subsp. abscessus, Mycobacterium chitae, Mycobacterium chlorophenolicum, Mycobacterium chubuense, Mycobacterium confluentis, Mycobacterium cookii, Mycobacterium diemhoferi, Mycobacterium doricum, Mycobacterium duvalii, Mycobacterium fallax, Mycobacterium farcinogenes, Mycobacterium flavescens, Mycobacterium frederiksbergense, Mycobacterium gadium, Mycobacterium gilvum, Mycobacterium gordonae, Mycobacterium hassiacum, Mycobacterium hiberniae, Mycobacterium hodleri, Mycobacterium holsaticum, Mycobacterium komossense, Mycobacterium lacus, Mycobacterium madagascariense, Mycobacterium mageritense, Mycobacterium montefiorense, Mycobacterium moriokaense, Mycobacterium murale, Mycobacterium neoaurum, Mycobacterium nonchromogenicum, Mycobacterium obuense, Mycobacterium palustre, Mycobacterium parafortuitum, Mycobacterium peregrinum, Mycobacterium phlei, Mycobacterium pinnipedii, Mycobacterium poriferae, Mycobacterium pulveris, Mycobacterium rhodesiae, Mycobacterium shottsii, Mycobacterium sphagni, Mycobacterium terrae, Mycobacterium thermoresistibile, Mycobacterium tokaiense, Mycobacterium triviale, Mycobacterium tusciae or Mycobacterium vanbaalenii; Nocardiaceae such as the genera Nocardia, Rhodococcus e.g. the species Nocardia abscessus, Nocardia africana, Nocardia amarae, Nocardia asteroides, Nocardia autotrophica, Nocardia beijingensis, Nocardia brasiliensis, Nocardia brevicatena, Nocardia caishijiensis, Nocardia calcarea, Nocardia carnea, Nocardia cellulans, Nocardia cerradoensis, Nocardia coeliaca, Nocardia corynebacterioides, Nocardia crassostreae, Nocardia cummidelens, Nocardia cyriacigeorgica, Nocardia farcinica, Nocardia flavorosea, Nocardia fluminea, Nocardia globerula, Nocardia hydrocarbonoxydans, Nocardia ignorata, Nocardia mediterranei, Nocardia nova, Nocardia orientalis, Nocardia otitidis-caviarum, Nocardia otitidiscaviarum, Nocardia paucivorans, Nocardia petroleophila, Nocardia pinensis, Nocardia pseudobrasiliensis, Nocardia pseudovaccinii, Nocardia puris, Nocardia restricta, Nocardia rugosa, Nocardia salmonicida, Nocardia saturnea, Nocardia seriolae, Nocardia soli, Nocardia sulphurea, Nocardia transvalensis, Nocardia uniformis, Nocardia vaccinii, Nocardia veterana or Nocardia vinacea; Pseudomonaceae such as the genera Azomonas, Azotobacter, Cellvibrio, Chryseomonas, Flaviomonas, Lampropedia, Mesophilobacter, Morococcus, Oligella, Pseudomonas, Rhizobacter, Rugamonas, Serpens, Thermoleophilum, Xylophilus e.g. the species Azomonas agilis, Azomonas insignis, Azomonas macrocytogenes, Azotobacter agilis, Azotobacter agilis subsp. armeniae, Azotobacter armeniacus, Azotobacter beijerinckii, Azotobacter chroococcum, Azotobacter indicum, Azotobacter macrocytogenes, Azotobacter miscellum, Azotobacter nigricans subsp. nigricans, Azotobacter paspali, Azotobacter salinestris, Azotobacter sp., Azotobacter vinelandii, Flavimonas oryzihabitans, Mesophilobacter marinus, Oligella urethralis, Pseudomonas acidovorans, Pseudomonas aeruginosa, Pseudomonas agarici, Pseudomonas alcaligenes, Pseudomonas aminovorans, Pseudomonas amygdali, Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocoffigans, Pseudomonas balearica, Pseudomonas barkeri, Pseudomonas bathycetes, Pseudomonas beijerinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chloritidismutans, Pseudomonas chlororaphis, Pseudomonas cichorii, Pseudomonas citronellolis, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes subsp. konjaci, Pseudomonas pseudoalcaligenes subsp. pseudoalcaligenes, Pseudomonas pseudoflava, Pseudomonas putida, Pseudomonas putida var. naraensis, Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbicans, Pseudomonas ruhlandii, Pseudomonas saccharophila, Pseudomonas savastanoi, Pseudomonas savastanoi pvar. glycinea, Pseudomonas savastanoi pvar. phaseolicola, Pseudomonas solanacearum, Pseudomonas sp., Pseudomonas spinosa, Pseudomonas stanieri, Pseudomonas stutzeri, Pseudomonas syringae, Pseudomonas syringae pvar. aptata, Pseudomonas syringae pvar. atrofaciens, Pseudomonas syringae pvar. coronafaciens, Pseudomonas syringae pvar. delphinii, Pseudomonas syringae pvar. glycinea, Pseudomonas syringae pvar. helianthi, Pseudomonas syringae pvar. lachrymans, Pseudomonas syringae pvar. lapsa, Pseudomonas syringae pvar. morsprunorum, Pseudomonas syringae pvar. phaseolicola, Pseudomonas syringae pvar. primulae, Pseudomonas syringae pvar. syringae, Pseudomonas syringae pvar. tabaci, Pseudomonas syringae pvar. tomato, Pseudomonas syringae subsp. glycinea, Pseudomonas syringae subsp. savastanoi, Pseudomonas syringae subsp. syringae, Pseudomonas syzygii, Pseudomonas tabaci, Pseudomonas taeniospiralis, Pseudomonas testosteroni, Pseudomonas thermocarboxydovorans, Pseudomonas thermotolerans, Pseudomonas thivervalensis, Pseudomonas tomato, Pseudomonas trivialis, Pseudomonas veronii, Pseudomonas vesicularis, Pseudomonas viridiflava, Pseudomonas viscogena, Pseudomonas woodsii, Rhizobacter dauci, Rhizobacter daucus or Xylophilus ampelinus; Rhizobiaceae such as the genera Agrobacterium, Carbophilus, Chelatobacter, Ensifer, Rhizobium, Sinorhizobium e.g. the species Agrobacterium atlanticum, Agrobacterium ferrugineum, Agrobacterium gelatinovorum, Agrobacterium larrymoorei, Agrobacterium meteori, Agrobacterium radiobacter, Agrobacterium rhizogenes, Agrobacterium rubi, Agrobacterium stepllulatum, Agrobacterium tumefaciens, Agrobacterium vitis, Carbophilus carboxidus, Chelatobacter heintzii, Ensifer adhaerens, Ensifer arboris, Ensifer fredii, Ensifer kostiensis, Ensifer kummerowiae, Ensifer medicae, Ensifer meliloti, Ensifer saheli, Ensifer terangae, Ensifer xinjiangensis, Rhizobium ciceri Rhizobium etli, Rhizobium fredii, Rhizobium galegae,

*Rhizobium gafficum, Rhizobium giardinii, Rhizobium hainanense, Rhizobium huakuii, Rhizobium huautlense, Rhizobium indigoferae, Rhizobium japonicum, Rhizobium leguminosarum, Rhizobium loessense, Rhizobium loti, Rhizobium lupini, Rhizobium mediterraneum, Rhizobium meliloti, Rhizobium mongolense, Rhizobium phaseoli, Rhizobium radiobacter, Rhizobium rhizogenes, Rhizobium rubi, Rhizobium sullae, Rhizobium tianshanense, Rhizobium trifolii, Rhizobium tropici, Rhizobium undicola, Rhizobium vitis, Sinorhizobium adhaerens, Sinorhizobium arboris, Sinorhizobium fredii, Sinorhizobium kostiense, Sinorhizobium kummerowiae, Sinorhizobium medicae, Sinorhizobium meliloti, Sinorhizobium morelense, Sinorhizobium saheli* or *Sinorhizobium xinjiangense*; Streptomycetaceae such as the genera *Kitasatosprora, Streptomyces, Streptoverticillium* e.g. the species *Streptomyces abikoensis, Streptomyces aburaviensis, Streptomyces achromogenes* subsp. *achromogenes, Streptomyces achromogenes* subsp. *rubradiris, Streptomyces acidiscabies, Streptomyces acrimycini, Streptomyces aculeolatus, Streptomyces afghaniensis, Streptomyces alanosinicus, Streptomyces albaduncus, Streptomyces albiaxialis, Streptomyces albidochromogenes, Streptomyces albidoflavus, Streptomyces albireticuli, Streptomyces albofaciens, Streptomyces alboflavus, Streptomyces albogriseolus, Streptomyces albolongus, Streptomyces alboniger, Streptomyces albospinus, Streptomyces albosporeus* subsp. *albosporeus, Streptomyces albosporeus* subsp. *labilomyceticus, Streptomyces alboverticillatus, Streptomyces albovinaceus, Streptomyces alboviridis, Streptomyces albulus, Streptomyces albus* subsp. *albus, Streptomyces albus* subsp. *pathocidicus, Streptomyces almquistii, Streptomyces althioticus, Streptomyces amakusaensis, Streptomyces ambofaciens, Streptomyces aminophilus, Streptomyces anandii, Streptomyces anthocyanicus, Streptomyces antibioticus, Streptomyces antimycoticus, Streptomyces anulatus, Streptomyces arabicus, Streptomyces ardus, Streptomyces arenae, Streptomyces argenteolus, Streptomyces armeniacus, Streptomyces asiaticus, Streptomyces asterosporus, Streptomyces atratus, Streptomyces atroaurantiacus, Streptomyces atroolivaceus, Streptomyces atrovirens, Streptomyces aurantiacus, Streptomyces aurantiogriseus, Streptomyces aureocirculatus, Streptomyces aureofaciens, Streptomyces aureorectus, Streptomyces aureoversilis, Streptomyces aureoverticillatus, Streptomyces aureus, Streptomyces avellaneus, Streptomyces avermectinius, Streptomyces avermitilis, Streptomyces avidinii, Streptomyces azaticus, Streptomyces azureus, Streptomyces baarnensis, Streptomyces bacillaris, Streptomyces badius, Streptomyces baldaccii, Streptomyces bambergiensis, Streptomyces beijiangensis, Streptomyces bellus, Streptomyces bikiniensis, Streptomyces biverticillatus, Streptomyces blastmyceticus, Streptomyces bluensis, Streptomyces bobili, Streptomyces bottropensis, Streptomyces brasiliensis, Streptomyces bungoensis, Streptomyces cacaoi* subsp. *asoensis, Streptomyces cacaoi* subsp. *cacaoi, Streptomyces caelestis, Streptomyces caeruleus, Streptomyces californicus, Streptomyces calvus, Streptomyces canaries, Streptomyces candidus, Streptomyces canescens, Streptomyces cangkringensis, Streptomyces caniferus, Streptomyces canus, Streptomyces capillispiralis, Streptomyces capoamus, Streptomyces carpaticus, Streptomyces carpinensis, Streptomyces catenulae, Streptomyces caviscabies, Streptomyces cavourensis* subsp. *cavourensis, Streptomyces cavourensis* subsp. *washingtonensis, Streptomyces cellostaticus, Streptomyces celluloflavus, Streptomyces cellulolyticus, Streptomyces cellulosae, Streptomyces champavatii, Streptomyces chartreuses, Streptomyces chattanoogensis, Streptomyces chibaensis, Streptomyces chrestomyceticus, Streptomyces chromofuscus, Streptomyces chryseus, Streptomyces chrysomallus* subsp. *chrysomallus, Streptomyces chrysomallus* subsp. *fumigatus, Streptomyces cinereorectus, Streptomyces cinereoruber* subsp. *cinereoruber, Streptomyces cinereoruber* subsp. *fructofermentans, Streptomyces cinereospinus, Streptomyces cinereus, Streptomyces cinerochromogenes, Streptomyces cinnabarinus, Streptomyces cinnamonensis, Streptomyces cinnamoneus, Streptomyces cinnamoneus* subsp. *albosporus, Streptomyces cinnamoneus* subsp. *cinnamoneus, Streptomyces cinnamoneus* subsp. *lanosus, Streptomyces cinnamoneus* subsp. *sparsus, Streptomyces cirratus, Streptomyces ciscaucasicus, Streptomyces citreofluorescens, Streptomyces clavifer, Streptomyces clavuligerus, Streptomyces cochleatus, Streptomyces coelescens, Streptomyces coelicoflavus, Streptomyces coelicolor, Streptomyces coeruleoflavus, Streptomyces coeruleofuscus, Streptomyces coeruleoprunus, Streptomyces coeruleorubidus, Streptomyces coerulescens, Streptomyces collinus, Streptomyces colombiensis, Streptomyces corchorusii, Streptomyces costaricanus, Streptomyces cremeus, Streptomyces crystallinus, Streptomyces curacoi, Streptomyces cuspidosporus, Streptomyces cyaneofuscatus, Streptomyces cyaneus, Streptomyces cyanoalbus, Streptomyces cystargineus, Streptomyces daghestanicus, Streptomyces diastaticus* subsp. *ardesiacus, Streptomyces diastaticus* subsp. *diastaticus, Streptomyces diastatochromogenes, Streptomyces distallicus, Streptomyces djakartensis, Streptomyces durhamensis, Streptomyces echinatus, Streptomyces echinoruber, Streptomyces ederensis, Streptomyces ehimensis, Streptomyces endus, Streptomyces enissocaesilis, Streptomyces erumpens, Streptomyces erythraeus, Streptomyces erythrogriseus, Streptomyces eurocidicus, Streptomyces europaeiscabiei, Streptomyces eurythermus, Streptomyces exfoliates, Streptomyces felleus, Streptomyces fervens, Streptomyces fervens* subsp. *fervens, Streptomyces fervens* subsp. *melrosporus, Streptomyces filamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flavisclericus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatisclericus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces Streptomyces glaucescens, Streptomyces glaucosporus, Streptomyces glaucus, Streptomyces globisporus* subsp. *caucasicus, Streptomyces globisporus* subsp. *flavofuscus, Streptomyces globisporus* subsp. *globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocarneus, Streptomyces griseochromogenes, Streptomyces griseoflavus, Streptomyces griseofuscus, Streptomyces griseoincarnatus, Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces*

*griseoverticillatus, Streptomyces griseoviridis, Streptomyces griseus* subsp. *alpha, Streptomyces griseus* subsp. *cretosus, Streptomyces griseus* subsp. *griseus, Streptomyces griseus* subsp. *solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus* subsp. *angustmyceticus, Streptomyces hygroscopicus* subsp. *decoyicus, Streptomyces hygroscopicus* subsp. *glebosus, Streptomyces hygroscopicus* subsp. *hygroscopicus, Streptomyces hygroscopicus* subsp. *ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae* subsp. *grasserius, Streptomyces lavendulae* subsp. *lavendulae, Streptomyces lavenduligriseus, Streptomyces lavendulocolor, Streptomyces levis, Streptomyces libani* subsp. *libani, Streptomyces libani* subsp. *rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces matensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporeus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli* subsp. *cellulophilus, Streptomyces olivoreticuli* subsp. *olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramulosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus* subsp. *paromomycinus, Streptomyces rimosus* subsp. *rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, Streptomyces rubiginosohelvolus, Streptomyces rubiginosus, Streptomyces rubrogriseus, Streptomyces rutgersensis* subsp. *castelarensis, Streptomyces rutgersensis* subsp. *rutgersensis, Streptomyces salmonis, Streptomyces sampsonii, Streptomyces sanglieri, Streptomyces sannanensis, Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces the rmodiastaticus, Streptomyces thermogriseus, Streptomyces thermolineatus, Streptomyces thermonitrificans, Streptomyces thermospinosisporus, Streptomyces thermoviolaceus* subsp. *apingens, Streptomyces thermoviolaceus* subsp. *thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vinaceus, Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces*

*virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticillium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium blastmyceticum, Streptoverticillium cinnamoneum* subsp. *albosporum, Streptomyces cinnamoneus* subsp. *albosporus, Streptoverticillium cinnamoneum* subsp. *cinnamoneum, Streptoverticillium cinnamoneum* subsp. *lanosum, Streptoverticillium cinnamoneum* subsp. *sparsum, Streptoverticillium distallicum, Streptoverticillium ehimense, Streptoverticillium eurocidicum, Streptoverticillium fervens* subsp. *fervens, Streptoverticillium fervens* subsp. *melrosporus, Streptoverticillium flavopersicum, Streptoverticillium griseocameum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli* subsp. *cellulophilum, Streptoverticillium olivoreticuli* subsp. *olivoreticuli, Streptoverticillium olivoreticulum, Streptoverticillium olivoreticulum* subsp. *cellulophilum, Streptoverticillium olivoverticillatum, Streptoverticillium orinoci, Streptoverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptoverticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum*.

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida Candida bombicola, Candida cylindracea, Candida parapsilosis, Candida rugosa, Candida tropicalis, Pichia methanolica* and *Pichia pastoris*.

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium,*

*Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species *laurel Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elaeis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata*. [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticifflflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia [macadamia]*; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can in princible also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana*. Fabaceae such as the genera *Glycine* e.g. the species *Glycine max, Soja hispida* or *Soja max* [soybean] (wobei ich nicht sicher bin, ob es Soja max überhaupt gibt, die heißt eigentlich *Glycine max*). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor [Sorghum, millet], Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersi-* con esculentum, Lycopersicon lycopersicum, Lycopersicon pyriforme, Solanum integrifolium or Solanum lycopersicum [tomato].

All abovementioned organisms can in princible also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) a nucleic acid sequence as indicated in Table I, columns 5 or 7, lines 16 to 18 and/or lines 356 to 362 a derivative thereof, or
b) a genetic regulatory element, for example a promoter, which is functionally linked to the nucleic acid sequence as indicated in Table I, columns 5 or 7, lines 16 to 18 and/or lines 356 to 362, or a derivative thereof, or
c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The respective fine chemical, which is synthesized in the organism, in particular the microorganism, the cell, the tissue or the plant, of the invention can be isolated if desired. Depending on the use of the respective fine chemical, different purities resulting from the purification may be advantageous as will be described herein below.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine or tryptophane.

In one embodiment, after an activity of a polypeptide of the present invention or used in the process of the present invention has been increased or generated, or after the expression of a nucleic acid molecule or polypeptide according to the invention has been generated or increased, the transgenic plant generated can be grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure respective fine chemical or chemically pure compositions comprising the respective fine chemical may also be produced by the process described above. To this end, the respective fine chemical or the compositions are isolated in the known manner from an organism according to the invention, such as the microorganisms, non-human animal or the plants, and/or their culture medium in which or on which the organisms had been grown. These chemically pure respective fine chemical or said compositions are advantageous for applications in the field of the food industry, the cosmetics industry or the pharmaceutical industry.

Thus, the content of plant components and preferably also further impurities is as low as possible, and the abovementioned respective fine chemical is obtained in as pure form as possible. In these applications, the content of plant components advantageously amounts to less than 10%, preferably 1%, more preferably 0.1%, very especially preferably 0.01% or less.

Accordingly, the respective fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the respective fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found a tissue, more preferred in an organism or in a harvestable part thereof.

In principle, the respective fine chemicals produced can be increased in two ways by the process according to the invention. The pool of free respective fine chemicals, in particular of the free respective fine chemical, and/or the content of protein-bound respective fine chemicals, in particular of the protein-bound respective fine chemical may advantageously be increased.

It may be advantageous to increase the pool of free amino acids in the transgenic organisms by the process according to the invention in order to isolate high amounts of the pure respective fine chemical.

In another preferred embodiment of the invention a combination of the increased expression of the nucleic acid sequence or the protein of the invention together with the transformation of a protein or polypeptide, which functions as a sink for the desired amino acid for example methionine, lysine or threonine in the organism is useful to increase the production of the respective fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670,635). Galili et al., Transgenic Res. 2000 showed, that enhancing the synthesis of threonine by a feed back insensitive aspartate kinase did not lead only to in increase in free threonine but also in protein bound threonine.

In may also be advantageous to increase the content of the protein-bound respective fine chemical.

In a preferred embodiment, the fine chemical (tryptophane) is produced in accordance with the invention and, if desired, is isolated. The production of further amino acids such as methionine, lysine and/or threonine mixtures of amino acid by the process according to the invention is advantageous.

In the case of the fermentation of microorganisms, the abovementioned amino acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamid resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acide. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews MJ, 1997 (Lysine, threonine and methionine biosynthesis. In BK Singh, ed, Plant Amino Acids: Biochemistry and Biotechnology. Dekker, New York, pp 205-225; H Hesse and R Hoefgen. (2003) Molecular aspects of methionine biosynthesis. TIPS 8(259-262.

In a preferred embodiment, the present invention relates to a process for the production of the fine chemical comprising or generating in an organism or a part thereof the expression of at least one nucleic acid molecule comprising a nucleic acid molecule selected from the group consisting of:

(a) nucleic acid molecule encoding, preferably at least the mature form, of a polypeptide having a sequence as indicated in Table II, columns 5 or 7, lines 16 to 18 and/or lines 356 to 362;

(b) nucleic acid molecule comprising, preferably at least the mature form, of a nucleic acid molecule having a sequence as indicated in Table I, columns 5 or 7, lines 16 to 18 and/or lines 356 to 362;

(c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

(d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

(e) nucleic acid molecule which hybridizes with a nucleic acid molecule of (a) to (c) under r stringent hybridisation conditions and conferring an increase in the amount of the fine chemical in an organism or a part thereof;

(f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

(g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

(h) nucleic acid molecule comprising a nucleic acid molecule which is obtained by amplifying nucleic acid molecules from a cDNA library or a genomic library using the primers pairs having a sequence as indicated in Table III, columns 7, lines 16 to 18 and/or lines 356 to 362 and conferring an increase in the amount of the fine chemical in an organism or a part thereof;

(i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

(j) nucleic acid molecule which encodes a polypeptide comprising the consensus sequence having a sequences as indicated in Table IV, column 7, lines 16 to 18 and/or lines 356 to 362, and conferring an increase in the amount of the fine chemical in an organism or a part thereof;

(k) nucleic acid molecule comprising one or more of the nucleic acid molecule encoding the amino acid sequence of a polypeptide encoding a domain of a polypeptide indicated in Table II, columns 5 or 7, lines 16 to 18 and/or lines 356 to 362, and conferring an increase in the amount of the fine chemical in an organism or a part thereof; and (l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in Table IA, columns 5 or 7, lines 16 to 18 and/or lines 356 to 362, by one or more nucleotides. In one embodiment, the nucleic acid molecule used in the process of the invention does not consist of the sequence indicated in Table I A, columns 5 or 7, lines 16 to 18 and/or lines 356 to 362: In one embodiment, the nucleic acid molecule used in the process of the invention is less than 100%, 99.999%, 99.99%, 99.9% or 99% identical to a sequence indicated in Table I A, columns 5 or 7, lines 16 to 18 and/or lines 356 to 362. In another embodiment, the nucleic acid molecule does not encode a polypeptide of a sequence indicated in Table II A, columns 5 or 7, lines 16 to 18 and/or lines 356 to 362.

In one embodiment, the nucleic acid molecule used in the process of the invention distinguishes over the sequence indicated in Table I B, columns 5 or 7, lines 16 to 18 and/or lines 356 to 362, by one or more nucleotides. In one embodiment, the nucleic acid molecule used in the process of the invention does not consist of the sequence shown in indicated in Table I B, columns 5 or 7, lines 16 to 18 and/or lines 356 to 362: In one embodiment, the nucleic acid molecule used in the process of the invention is less than 100%, 99.999%, 99.99%, 99.9% or 99% identical to a sequence indicated in Table I B, columns 5 or 7, lines 16 to 18 and/or lines 356 to 362. In another embodiment, the nucleic acid molecule does not encode a polypeptide of a sequence indicated in Table II B, columns 5 or 7, lines 16 to 18 and/or lines 356 to 362.

In one embodiment, the nucleic acid molecule of the invention or used in the process of the invention distinguishes over the sequence indicated in Table I, columns 5 or 7, lines 16 to 18 and/or lines 356 to 362, by one or more nucleotides. In one embodiment, the nucleic acid molecule of the present invention or used in the process of the invention does not consist of the sequence n indicated in Table I, columns 5 or 7, lines 16 to 18 and/or lines 356 to 362. In one embodiment, the nucleic acid molecule of the present invention is less than 100%, 99.999%, 99.99%, 99.9% or 99% identical to a sequence indicated in Table I, columns 5 or 7, lines 16 to 18 and/or lines 356 to 362 In another embodiment, the nucleic acid molecule does not encode a polypeptide of a sequence indicated in Table I, columns 5 or 7, lines 16 to 18 and/or lines 356 to 362.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, The terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as indicated in Table I, columns 5 or 7, lines 16 to 18 and/or lines 356 to 362 nucleic acid molecules which are derived from a amino acid sequences as indicated in Table II, columns 5 or 7, lines 16 to 18 and/or lines 356 to 362 or from polypeptides comprising the consensus sequence as indicated in Table IV, column 7, lines 16 to 18 and/or lines 356 to 362 or their derivatives or homologues encoding polypeptides with the enzymatic or biological activity of a polypeptide as indicated in Table II, column 3, 5 or 7, lines 16 to 18 and/or lines 356 to 362 or e.g. conferring a increase of the fine chemical after increasing its expression or activity are advantageously increased in the process according to the invention.

In one embodiment, said sequences are cloned into nucleic acid constructs, either individually or in combination. These nucleic acid constructs enable an optimal synthesis of the respective fine chemical produced in the process according to the invention.

Nucleic acid molecules, which are advantageous for the process according to the invention and which encode polypeptides with an activity of a polypeptide of the invention or the polypeptide used in the method of the invention or used in the process of the invention, e.g. of a protein as indicated in Table II, column 5, lines 16 to 18 and/or lines 356 to 362 or being encoded by a nucleic acid molecule indicated in Table I, column 5, lines 16 to 18 and/or lines 356 to 362 or of its homologs, e.g. as indicated in Table II, column 7, lines 16 to 18 and/or lines 356 to 362 can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Chemy J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with an activity of a polypeptide as indicated in Table II, column 3, lines 16 to 18 and/or lines 356 to 362 or having the sequence of a polypeptide as indicated in Table II, columns 5 and 7, lines 16 to 18 and/or lines 356 to 362 and conferring an tryptophane increase.

The nucleic acid sequence(s) used in the process for the production of the respective fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the respective fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the respective fine chemical produced in the process according to the invention. This improved production, or production efficiency, of the respective fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis*.

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus

*Saccharomyces* and the very advantageous genus and species *Saccharomyces cerevisiae* for the production of the respective fine chemical in microorganism.

The skilled worker knows other suitable sources for the production of respective fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*.

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

However, it is also possible to use artificial sequences, which differ in one or more bases from the nucleic acid sequences found in organisms, or in one or more amino acid molecules from polypeptide sequences found in organisms, in particular from the polypeptide sequences indicated in Table II, columns 5 or 7, lines 16 to 18 and/or lines 356 to 362 or the functional homologues thereof as described herein, preferably conferring above-mentioned activity, i.e. conferring a increase of the fine chemical after increasing its activity.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as the pairs indicated in Table III, column 7, lines 16 to 18 and/or lines 356 to 362 by means of polymerase chain reaction can be generated on the basis of a sequence as indicated in Table I, columns 5 or 7, lines 16 to 18 and/or lines 356 to 362 or the sequences derived from sequences as indicated in Table II, columns 5 or 7, lines 16 to 18 and/or lines 356 to 362.

Moreover, it is possible to identify conserved regions from various organisms by carrying out protein sequence alignments with the polypeptide used in the process of the invention, in particular with sequences of the polypeptide of the invention or the polypeptide used in the method of the invention, from which conserved regions, and in turn, degenerate primers can be derived. Conserved region for the polypeptide of the invention or the polypeptide used in the method of the invention are indicated in the alignments shown in the figures. Conserved regions are those, which show a very little variation in the amino acid in one particular position of several homologs from different origin. The consensus sequences indicated in Table IV, column 7, lines 16 to 18 and/or lines 356 to 362 are derived from said alignments.

Degenerated primers can then be utilized by PCR for the amplification of fragments of novel proteins having abovementioned activity, e.g. conferring the increase of the respective fine chemical after increasing its expression or activity or further functional homologs of the polypeptide of the invention or the polypeptide used in the method of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants.

Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown herein below:
(1) Hybridization conditions can be selected, for example, from the following conditions:
a) 4×SSC at 65° C.,
b) 6×SSC at 45° C.,
c) 6×SSC, 100 mg/ml denatured fragmented fish sperm DNA at 68° C.,
d) 6×SSC, 0.5% SDS, 100 mg/ml denatured salmon sperm DNA at 68° C.,
e) 6×SSC, 0.5% SDS, 100 mg/ml denatured fragmented salmon sperm DNA, 50% formamide at 42° C.,
f) 50% formamide, 4×SSC at 42° C.,
g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
h) 2× or 4×SSC at 50° C. (low-stringency condition), or
i) 30 to 40% formamide, 2× or 4×SSC at 42° C. (low-stringency condition).
(2) Wash steps can be selected, for example, from the following conditions:
a) 0.015 M NaCl/0.0015 M sodium citrate/0.1% SDS at 50° C.
b) 0.1×SSC at 65° C.
c) 0.1×SSC, 0.5% SDS at 68° C.
d) 0.1×SSC, 0.5% SDS, 50% formamide at 42° C.
e) 0.2×SSC, 0.1% SDS at 42° C.
f) 2×SSC at 65° C. (low-stringency condition).

Polypeptides having above-mentioned activity, i.e. conferring a tryptophane increase, derived from other organisms, can be encoded by other DNA sequences which hybridize to a sequences indicated in Table I, columns 5 or 7, lines 16 to 18 and/or lines 356 to 362 under relaxed hybridization conditions and which code on expression for peptides having the tryptophane increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the respective fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridising with the nucleic acid molecule of the invention or the nucleic acid molecule used in the method of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the respective fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences indicated in Table I, columns 5 or 7, lines 16 to 18 and/or lines 356 to 362 is one which is sufficiently complementary to one of said nucleotide sequences such that it can hybridize to one of said nucleotide sequences thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence indicated in Table I, columns 5 or 7, lines 16 to 18 and/or lines 356 to 362, preferably of Table I B, columns 5 or 7, lines 16 to 18 and/or lines 356 to 362 or a functional portion thereof and preferably has above mentioned activity, in particular has the-fine-chemical-increasing activity after increasing its activity or an activity of a product of a gene encoding said sequence or its homologs.

The nucleic acid molecule of the invention comprises a nucleotide sequence which hybridizes, preferably hybridizes under stringent conditions as defined herein, to one of the nucleotide sequences indicated in Table I, columns 5 or 7, lines 16 to 18 and/or lines 356 to 362, preferably of Table I B, columns 5 or 7, lines 16 to 18 and/or lines 356 to 362 or a portion thereof and encodes a protein having above-mentioned activity and as indicated in indicated in Table II, columns 5 or 7, lines 16 to 18 and/or lines 356 to 362, preferably of Table II B, columns 5 or 7, lines 16 to 18 and/or lines 356 to 362, e.g. conferring an increase of the fine chemical.

Optionally, the nucleotide sequence, which hybridises to one of the nucleotide sequences indicated in Table I, columns 5 or 7, lines 16 to 18 and/or lines 356 to 362, preferably of Table I B, columns 5 or 7, lines 16 to 18 and/or lines 356 to 362 has further one or more of the activities annotated or known for a protein as indicated in Table II, column 3, lines 16 to 18 and/or lines 356 to 362.

Moreover, the nucleic acid molecule of the invention or used in the process of the invention can comprise only a portion of the coding region of one of the sequences indicated in Table I, columns 5 or 7, lines 16 to 18 and/or lines 356 to 362, preferably of Table I B, columns 5 or 7, lines 16 to 18 and/or lines 356 to 362, for example a fragment which can be used as a probe or primer or a fragment encoding a biologically active portion of the polypeptide of the present invention or of a polypeptide used in the process of the present invention, i.e. having above-mentioned activity, e.g. conferring an increase of tryptophane if its activity is increased. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences indicated in Table I, columns 5 or 7, lines 16 to 18 and/or lines 356 to 362, an anti-sense sequence of one of the sequences indicated in Table I, columns 5 or 7, lines 16 to 18 and/or lines 356 to 362, or naturally occurring mutants thereof. Primers based on a nucleotide sequence of the invention can be used in PCR reactions to clone homologues of the polypeptide of the invention or of the polypeptide used in the process of the invention, e.g. as the primers described in the examples of the present invention, e.g. as shown in the examples. A PCR with the primer pairs indicated in Table III, column 7, lines 16 to 18 and/or lines 356 to 362 will result in a fragment of a polynucleotide sequence as indicated in Table I, columns 5 or 7, lines 16 to 18 and/or lines 356 to 362.

Primer sets are interchangeable. The person skilled in the art knows to combine said primers to result in the desired product, e.g. in a full-length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention encodes a polypeptide or portion thereof which includes an amino acid sequence which is sufficiently homologous to an amino acid sequence as indicated in Table II, columns 5 or 7, lines 16 to 18 and/or lines 356 to 362 such that the protein or portion thereof maintains the ability to participate in tryptophane production, in particular a tryptophane increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as indicated in Table II, columns 5 or 7, lines 16 to 18 and/or lines 356 to 362 such that the protein or portion thereof is able to participate in the increase of tryptophane production. In one embodiment, a protein or portion thereof as indicated in Table II, columns 5 or 7, lines 16 to 18 and/or lines 356 to 362 has for example an activity of a polypeptide indicated in Table II, column 3, lines 16 to 18 and/or lines 356 to 362.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence as indicated in Table II, columns 5 or 7, lines 16 to 18 and/or lines 356 to 362 and has above-mentioned activity, e.g. conferring preferably the increase of the fine chemical.

Portions of proteins encoded by the nucleic acid molecule of the invention or the nucleic acid molecule used in the method of the invention are preferably biologically active, preferably having above-mentioned annotated activity, e.g. conferring a increase the respective fine chemical after increase of activity.

As mentioned herein, the term "biologically active portion" is intended to include a portion, e.g., a domain/motif, that confers increase of the respective fine chemical or has an immunological activity such that it is binds to an antibody binding specifically to the polypeptide of the present invention or a polypeptide used in the process of the present invention for producing the respective fine chemical;

The invention further relates to nucleic acid molecules that differ from one of a nucleotide sequences as indicated in Table I, columns 5 or 7, lines 16 to 18 and/or lines 356 to 362 (and portions thereof) due to degeneracy of the genetic code and thus encode a polypeptide of the present invention, in particular a polypeptide having above mentioned activity, e.g. conferring an increase in tryptophane in a organism, e.g. as that polypeptides comprising the consensus sequences as indicated in Table IV, columns 5 or 7, lines 16 to 18 and/or lines 356 to 362 or of the polypeptide as indicated in Table II, columns 5 or 7, lines 16 to 18 and/or lines 356 to 362 or their functional homologues. Advantageously, the nucleic acid molecule of the invention or the nucleic acid molecule used in the method of the invention comprises, or in an other embodiment has, a nucleotide sequence encoding a protein comprising, or in an other embodiment having, a consensus sequences as indicated in Table IV, columns 5 or 7, lines 16 to 18 and/or lines 356 to 362 or of the polypeptide as indicated in Table II, columns 5 or 7, lines 16 to 18 and/or lines 356 to 362 or the functional homologues. In a still further embodiment, the nucleic acid molecule of the invention or the nucleic acid molecule used in the method of the invention encodes a full length protein which is substantially homologous to an amino acid sequence comprising a consensus sequence as indicated in Table IV, column 7, lines 16 to 18 and/or lines 356 to 362, or of a polypeptide as indicated in Table II, columns 5 or 7, lines 16 to 18 and/or lines 356 to 362 or the functional homologues thereof. However, in a preferred embodiment, the nucleic acid molecule of the present invention does not consist of a sequence as indicated in Table I, columns 5 or 7, lines 16 to 18 and/or lines 356 to 362. Preferably the nucleic acid molecule of the invention is a functional homologue or identical to a nucleic acid molecule indicated in Table I B, columns 5 or 7, lines 16 to 18 and/or lines 356 to 362.

In addition, it will be appreciated by those skilled in the art that DNA sequence polymorphisms that lead to changes in the amino acid sequences may exist within a population. Such genetic polymorphism in the gene encoding the polypeptide of the invention or the polypeptide used in the method of the invention or comprising the nucleic acid molecule of the invention or the nucleic acid molecule used in the method of the invention may exist among individuals within a population due to natural variation.

As used herein, the terms "gene" and "recombinant gene" refer to nucleic acid molecules comprising an open reading frame encoding the polypeptide of the invention or the polypeptide used in the method of the invention or comprising the nucleic acid molecule of the invention or the nucleic acid molecule used in the method of the invention or encoding the polypeptide used in the process of the present invention, preferably from a crop plant or from a microorganism useful for the production of respective fine chemicals, in particular for the production of the respective fine chemical. Such natural variations can typically result in 1-5% variance in the nucleotide sequence of the gene. Any and all such nucleotide variations and resulting amino acid polymorphisms in genes encoding a polypeptide of the invention or the polypeptide used in the method of the invention or comprising a the nucleic acid molecule of the invention or the nucleic acid molecule used in the method of the invention that are the result of natural variation and that do not alter the functional activity as described are intended to be within the scope of the invention.

Nucleic acid molecules corresponding to natural variants homologues of a nucleic acid molecule of the invention or the nucleic acid molecule used in the method of the invention, which can also be a cDNA, can be isolated based on their homology to the nucleic acid molecules disclosed herein using the nucleic acid molecule of the invention or the nucleic acid molecule used in the method of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising a sequence as indicated in Table I, columns 5 or 7, lines 16 to 18 and/or lines 356 to 362. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence as indicated in Table I, columns 5 or 7, lines 16 to 18 and/or lines 356 to 362 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. as indicated in Table I, columns 5 or 7, lines 16 to 18 and/or lines 356 to 362.

A "non-essential" amino acid residue is a residue that can be altered from the wild-type sequence of one without altering the activity of said polypeptide, whereas an "essential" amino acid residue is required for an activity as mentioned above, e.g. leading to an increase in the respective fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organism can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned activity, e.g. conferring an increase in the fine chemical in an organisms or parts thereof that contain changes in amino acid residues that are not essential for said activity. Such polypeptides differ in amino acid sequence from a sequence contained in as sequence as indicated in Table II, columns 5 or 7, lines 16 to 18 and/or lines 356 to 362, preferably of Table II B, column 7, lines 16 to 18 and/or lines 356 to 362 yet retain said activity described herein. The nucleic acid molecule can comprise a nucleotide sequence encoding a polypeptide, wherein the polypeptide comprises an amino acid sequence at least about 50% identical to an amino acid sequence as indicated in Table II, columns 5 or 7, lines 16 to 18 and/or lines 356 to 362, preferably of Table II B, column 7, lines 16 to 18 and/or lines 356 to 362 and is capable of participation in the increase of production of the fine chemical after increasing its activity, e.g. its expression. Preferably, the protein encoded by the nucleic acid molecule is at least about 60% identical to a sequence as indicated in Table II, columns 5 or 7, lines 16 to 18 and/or lines 356 to 362, preferably of Table II B, column 7, lines 16 to 18 and/or lines 356 to 362 more preferably at least about 70% identical to one of the sequences as indicated in Table II, columns 5 or 7, lines 16 to 18 and/or lines 356 to 362, preferably of Table II B, column 7, lines 16 to 18 and/or lines 356 to 362 even more preferably at least about 80%, 90% or 95% homologous to a sequence as indicated in Table II, columns 5 or 7, lines 16 to 18 and/or lines 356 to 362, preferably of Table II B, column 7, lines 16 to 18 and/or lines 356 to 362 and most preferably at least about 96%, 97%, 98%, or 99% identical to the sequence as indicated in Table II, columns 5 or 7, lines 16 to 18 and/or lines 356 to 362, preferably of Table II B, column 7, lines 16 to 18 and/or lines 356 to 362.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence which has a 80% homology with sequence SEQ ID No: 732 at the nucleic acid level is understood as meaning a sequence which, upon comparison with the sequence SEQ ID No: 732 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2.912 | Average mismatch: | −2.003 |

For example a sequence which has a 80% homology with sequence SEQ ID No: 733 at the protein level is understood as meaning a sequence which, upon comparison with the sequence SEQ ID No: 733 by the above program algorithm with the above parameter set, has a 80% homology.

Functional equivalents derived from one of the polypeptides as indicated in Table II, columns 5 or 7, lines 16 to 18 and/or lines 356 to 362 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table II, columns 5 or 7, lines 16 to 18 and/or lines 356 to 362 according to the invention and are distinguished by essentially the same properties as a polypeptide as indicated in Table II, columns 5 or 7, lines 16 to 18 and/or lines 356 to 362.

Functional equivalents derived from a nucleic acid sequence as indicated in Table I, columns 5 or 7, lines 16 to 18 and/or lines 356 to 362, preferably of Table I B, column 7, lines 16 to 18 and/or lines 356 to 362 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of a polypeptides as indicated in Table II, columns 5 or 7, lines 16 to 18 and/or lines 356 to 362, preferably of Table I B, column 7, lines 16 to 18 and/or lines 356 to 362 according to the invention and encode polypeptides having essentially the same properties as a polypeptide as indicated in Table II, columns 5 or 7, lines 16 to 18 and/or lines 356 to 362, preferably of Table I B, column 7, lines 16 to 18 and/or lines 356 to 362.

"Essentially the same properties" of a functional equivalent is above all understood as meaning that the functional equivalent has above mentioned activity, e.g. conferring an increase in the respective fine chemical amount while increasing the amount of protein, activity or function of said functional equivalent in an organism, e.g. a microorganism, a plant or plant or animal tissue, plant or animal cells or a part of the same.

A nucleic acid molecule encoding an homologous to a protein sequence of as indicated in Table II, columns 5 or 7, lines 16 to 18 and/or lines 356 to 362, preferably of Table II B, column 7, lines 16 to 18 and/or lines 356 to 362 can be created by introducing one or more nucleotide substitutions, additions or deletions into a nucleotide sequence of the nucleic acid molecule of the present invention, in particular as indicated in Table I, columns 5 or 7, lines 16 to 18 and/or lines 356 to 362 such that one or more amino acid substitutions, additions or deletions are introduced into the encoded protein. Mutations can be introduced into the encoding sequences of a sequences as indicated in Table I, columns 5 or 7, lines 16 to 18 and/or lines 356 to 362 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the respective fine chemical.

Following mutagenesis of one of the sequences shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with a sequence as indicated in Table I, columns 5 or 7, lines 16 to 18 and/or lines 356 to 362, preferably of Table I B, column 7, lines 16 to 18 and/or lines 356 to 362, or of the nucleic acid sequences derived from a sequences as indicated in Table II, columns 5 or 7, lines 16 to 18 and/or lines 356 to 362, preferably of Table I B, column 7, lines 16 to 18 and/or lines 356 to 362 comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from a sequence as indicated in Table I, columns 5 or 7, lines 16 to 18 and/or lines 356 to 362 or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises one or more sequences as indicated in Table I, columns 5 or 7, lines 16 to 18 and/or lines 356 to 362, preferably of Table I B, column 7, lines 16 to 18 and/or lines 356 to 36. In one embodiment it is preferred that the nucleic acid molecule comprises as little as possible other nucleotide sequences not shown in any one of sequences as indicated in Table I, columns 5 or 7, lines 16 to 18 and/or lines 356 to 362, preferably of Table I B, column 7, lines 16 to 18 and/or lines 356 to 362. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, a nucleic acid molecule use in the process of the invention is identical to a sequences as indicated in Table I, columns 5 or 7, lines 16 to 18 and/or lines 356 to 362, preferably of Table I B, column 7, lines 16 to 18 and/or lines 356 to 362.

Also preferred is that one or more nucleic acid molecule(s) used in the process of the invention encodes a polypeptide comprising a sequence as indicated in Table II, columns 5 or 7, lines 16 to 18 and/or lines 356 to 362, preferably of Table II B, column 7, lines 16 to 18 and/or lines 356 to 362. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment, the encoded polypeptide used in the process of the invention is identical to the sequences as indicated in Table II, columns 5 or 7, lines 16 to 18 and/or lines 356 to 362, preferably of Table II B, column 7, lines 16 to 18 and/or lines 356 to 362.

In one embodiment, the nucleic acid molecule of the invention or used in the process encodes a polypeptide comprising a sequence as indicated in Table II, columns 5 or 7, lines 16 to 18 and/or lines 356 to 362, preferably of Table II B, column 7, lines 16 to 18 and/or lines 356 to 362 and comprises less than 100 further nucleotides. In a further embodiment, said nucleic acid molecule comprises less than 30 further nucleotides. In one embodiment, the nucleic acid molecule used in the process is identical to a coding sequence encoding a sequences as indicated in Table II, columns 5 or 7, lines 16 to 18 and/or lines 356 to 362, preferably of Table II B, column 7, lines 16 to 18 and/or lines 356 to 362.

Polypeptides (=proteins), which still have the essential enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as indicated in Table II, columns 5 or 7, lines 16 to 18 and/or lines 356 to 362, preferably compared to a sequence as indicated in Table II, column 3 and 5, lines 16 to 18 and/or lines 356 to 362, and expressed under identical conditions.

In one embodiment, the polypeptide of the invention is a homolog consisting of or comprising the sequence as indicated in Table II B, columns 7, lines 16 to 18 and/or lines 356 to 362

Homologues of a sequences as indicated in Table I, columns 5 or 7, lines 16 to 18 and/or lines 356 to 362 or of a derived sequences as indicated in Table II, columns 5 or 7, lines 16 to 18 and/or lines 356 to 362 also mean truncated sequences, cDNA, single-stranded DNA or RNA of the coding and noncoding DNA sequence. Homologues of said sequences are also understood as meaning derivatives which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3' regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;

(e) optionally, growing and cultivating the organisms or the parts thereof; and (f) recovering, and optionally isolating, the free or bound respective fine chemical produced by the selected mutated organisms or parts thereof.

The organisms or part thereof produce according to the herein mentioned process of the invention an increased level of free and/or -bound respective fine chemical compared to said control or selected organisms or parts thereof.

In one embodiment, the organisms or part thereof produce according to the herein mentioned process of the invention an increased level of protein-bound respective fine chemical compared to said control or selected organisms or parts thereof.

Advantageously the selected organisms are mutagenized according to the invention. According to the invention mutagenesis is any change of the genetic information in the genome of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the respective fine chemical production.

The genes of the invention can also be activated by mutagenesis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagenesis as well as the respective agens is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like $Mu^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagenesis with N-methyl-N-nitro-nitroso-guanidine.

Other biological method are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungi, a yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention originate from bacteria, for example from Proteobacteria, in particular from Gammaproteobacteria, more preferred from Enterobacteriales, e.g. from the family Enterobacteriaceae, particularly from genera *Escherichia, Salmonella, Klebsiella*, advantageously form the species *Escherichia coli* K12.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; Glycine max*; sunflower linseed or maize or their homologues.

Accordingly, in one embodiment, the invention relates to a nucleic acid molecule which comprises a nucleic acid molecule selected from the group consisting of:

a) nucleic acid molecule encoding, preferably at least the mature form, of a polypeptide as indicated in Table II, columns 5 or 7, lines 16 to 18 and/or lines 356 to 362, preferably of Table II B, column 7, lines 16 to 18 and/or lines 356 to 362 or a fragment thereof conferring an increase in the amount of the fine chemical in an organism or a part thereof b) nucleic acid molecule comprising, preferably at least the mature form, of a nucleic acid molecule as indicated in Table II, columns 5 or 7, lines 16 to 18 and/or lines 356 to 362, preferably of Table II B, column 7, lines 16 to 18 and/or lines 356 to 362 or a fragment thereof conferring an increase in the amount of the fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying a cDNA library or a genomic library using primers or primer pairs as indicated in Table III, column 7, lines 16 to 18 and/or lines 356 to 362 and conferring an increase in the amount of the fine chemical in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule which encodes a polypeptide comprising the consensus sequence as indicated in Table IV, column 7, lines 16 to 18 and/or lines 356 to 362 and conferring an increase in the amount of the fine chemical in an organism or a part thereof;

k) nucleic acid molecule encoding the amino acid sequence of a polypeptide encoding a domain of a polypeptide as indicated in Table II, columns 5 or 7, lines 16 to 18 and/or lines 356 to 362, preferably of Table II B, column 7, lines 16 to 18 and/or lines 356 to 362 and conferring an increase in the amount of the fine chemical in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of a nucleic acid molecule as indicated in Table I, columns 5 or 7, lines 16 to 18 and/or lines 356 to 362, preferably of Table II B, column 7, lines 16 to 18 and/or lines 356 to 362 or a nucleic acid molecule encoding, preferably at least the mature form of, the polypeptide as indicated in Table II, columns 5 or 7, lines 16 to 18 and/or lines 356 to 362, preferably of Table II B, column 7, lines 16 to 18 and/or lines 356 to 362 and conferring an increase in the amount of the fine chemical in an organism or a part thereof;

or which encompasses a sequence which is complementary thereto;

whereby, preferably, the nucleic acid molecule according to (a) to (l)

distinguishes over the sequence indicated in Table IA columns 5 or 7, lines 16 to 18 and/or lines 356 to 362, by one or more nucleotides. In one embodiment, the nucleic acid molecule does not consist of the sequence shown and in indicated in Table I A or I B, columns 5 or 7, lines 16 to 18 and/or lines 356 to 362: In one embodiment, the nucleic acid molecule is less than 100%, 99.999%, 99.99%, 99.9% or 99% identical to a sequence indicated in Table I A or I B, columns 5 or 7, lines 16 to 18 and/or lines 356 to 362. In another embodiment, the nucleic acid molecule does not encode a polypeptide of a sequence indicated in Table II A or II B, columns 5 or 7, lines 16 to 18 and/or lines 356 to 362. In an other embodiment, the nucleic acid molecule of the present invention is at least 30%, 40%, 50%, or 60% identical and less than 100%, 99.999%, 99.99%, 99.9% or 99% identical to a sequence indicated in Table I A or I B, columns 5 or 7, lines 16 to 18 and/or lines 356 to 362. In a further embodiment the nucleic acid molecule does not encode a polypeptide sequence as indicated in Table II A or II B, columns 5 or 7, lines 16 to 18 and/or lines 356 to 362. Accordingly, in one embodiment, the nucleic acid molecule of the differs at least in one or more residues from a nucleic acid molecule indicated in Table I A or I B, columns 5 or 7, lines 16 to 18 and/or lines 356 to 362. Accordingly, in one embodiment, the nucleic acid molecule of the present invention encodes a polypeptide, which differs at least in one or more amino acids from a polypeptide indicated in Table II A or I B, columns 5 or 7, lines 16 to 18 and/or lines 356 to 362. In another embodiment, a nucleic acid molecule indicated in Table I A or I B, columns 5 or 7, lines 16 to 18 and/or lines 356 to 362 does not encode a protein of a sequence indicated in Table II A or II B, columns 5 or 7, lines 16 to 18 and/or lines 356 to 362. Accordingly, in one embodiment, the protein encoded by a sequences of a nucleic acid according to (a) to (l) does not consist of a sequence as indicated in Table II A or II B, columns 5 or 7, lines 16 to 18 and/or lines 356 to 362. In a further embodiment, the protein of the present invention is at least 30%, 40%, 50%, or 60% identical to a protein sequence indicated in Table II A or II B, columns 5 or 7, lines 16 to 18 and/or lines 356 to 362 and less than 100%, preferably less than 99.999%, 99.99% or 99.9%, more preferably less than 99%, 985, 97%, 96% or 95% identical to a sequence as indicated in Table I A or II B, columns 5 or 7, lines 16 to 18 and/or lines 356 to 362.

The nucleic acid sequences used in the process are advantageously introduced in a nucleic acid construct, preferably an expression cassette which makes possible the expression of the nucleic acid molecules in an organism, advantageously a plant or a microorganism.

Accordingly, the invention also relates to an nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:
(a) introducing of a nucleic acid construct comprising the nucleic acid molecule of the invention or used in the process of the invention or encoding the polypeptide of the present invention or used in the process of the invention; or (b) introducing of a nucleic acid molecule, including regulatory sequences or factors, which expression increases the expression of the nucleic acid molecule of the invention or used in the process of the invention or encoding the polypeptide of the present invention or used in the process of the invention;
in a cell, or an organism or a part thereof, preferably in a plant, plant cell or a microorganism, and
(c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned in particular are various binary and cointegrated vector systems which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula, Pichia, Yerrowia, Saccharomyces, Schizosaccharomyces* or *Candida*.

Host organisms which are especially advantageously selected in the process according to the invention are microorganisms selected from the group of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the firet alternative, the constructs, which comprise the codogenic gene segment or the nucleic acid molecule of the invention or the nucleic acid molecule used in the method of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorgansim.

In addition to a sequence as indicated in Table I, columns 5 or 7, lines 16 to 18 and/or lines 356 to 362 or its derivatives, it is advantageous additionally to express and/or mutate further genes in the organisms. Especially advantageously, additionally at least one further gene of the amino acid biosynthetic pathway such as for L-lysine, L-threonine and/or L-methionine or L-tryptophane is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all.

In addition it might be advantageously to combine a sequences as indicated in Table I, columns 5 or 7, lines 16 to 18 and/or lines 356 to 362 with genes which generally support or enhances to growth or yield of the target organismn, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the amino acid metabolism, in particular in amino acid synthesis.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine. Furthermore, an advantageous nucleic acid sequence coexpressed can be threonine adlolase and/or lysine decarboxylase as described in the state of the art.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the respective fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60, 70, 80 or 90%, compared with the starting organism, and thus the activity of the enzyme is increased by these figures mentioned compared with the starting organism. An increase in the enzymatic activity means an enzymatic activity which is increased by at least 10%, advantageously at least 20, 30, 40 or 50%, particularly advantageously by at least 60, 70, 80, 90, 100, 200, 300, 500 or 1000%, compared with the starting organism. This leads to an increased productivity of the desired respective fine chemical or of the desired respective fine chemicals.

In a further advantageous embodiment of the process of the invention, the organisms used in the process are those in which simultaneously a tryptophane degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or the nucleic acid molecule used in the method of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to the coding sequence of the nucleic acid molecule of the invention or the nucleic acid molecule used in the method of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the $\Omega$ enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a NT-rich sequence which act as quantitative enhancers of gene expression in transgenic tobacco and potato plants (Sandhu et al., 1998; Plant Mol. Biol. 37(5):885-96). Beside that, a large variety of cis-active elements have been described which contribute to specific expression pattern, like organ specific expression or induced expression in response to biotic or abiotic stress. Examples are elements which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, lacI$^{q-}$, T7, T5, T3, gal, trc, ara, SP6, $\lambda$-P$_R$ or $\lambda$-P$_L$ promoter, which are advantageously used in Gram-negative bacteria. Further advantageous regulatory sequences are present for example in the Gram-positive promoters amy, dnaK, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4–, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention or the nucleic acid molecule used in the method of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein. This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination arepolyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cellTargeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention a plant can be advantageous. However, inducible expression of the polypeptide of the invention or the polypeptide used in the method of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3):459-67), the *Arabidopsis oleosin* promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the inventioncomprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the respective fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signalsThese regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992),Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.: 583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion *E. coli* expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident A-prophage which harbors a T7 gn1 gene under the transcriptional control of the lacUV 5 promoter.

Other vectors which are suitable in prokaryotic organisms are known to the skilled worker; these vectors are for example in *E. coli* pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III$^{113}$-B1, λgt11 or pBdCl, in *Streptomyces* pIJ101, pIJ364, pIJ702 or pIJ361, in *Bacillus* pUB110, pC194 or pBD214, in *Corynebacterium* pSA77 or pAJ667.

In a further embodiment, the expression vector is a yeast expression vector. Examples of vectors for expression in the yeasts *S. cerevisiae* encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 µM, pAG-1, YEp6, YEp13 or pEMBLYe23.

Further vectors, which may be mentioned by way of example, are pALS1, pIL2 or pBB116 in fungi or pLGV23, pGHlac⁺, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell. Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The amino acids produced can be isolated from the organism by methods with which the skilled worker is familiar. For example via extraction, salt precipitation and/or ion-exchange chromatography. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas (Bioreaktoren and periphere Einrichtungen (Vieweg Verlag, Braunschweig/Wiesbaden, 1994)).

In one embodiment, the present invention relates to a polypeptide encoded by the nucleic acid molecule according to the present invention, preferably conferring an increase in the respective fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with an eukaryotic organism as host cell. E.g., in one embodiment the polypeptide is produced in a plant cell or plant with a nucleic acid molecule derived from a prokaryote or a fungus or an alga or an other microorganism but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in *E. coli* there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, a native polypeptide conferring the increase of the fine chemical in an organism or part thereof can be isolated from cells (e.g., endothelial cells), for example using the antibody of the present invention as described below, in particular, an antibody against a protein as indicated in Table II, column 3, lines 16 to 18 and/or lines 356 to 362 E.g. an antibody against a polypeptide as indicated in Table II, columns 5 or 7, lines 16 to 18 and/or lines 356 to 362, which can be produced by standard techniques utilizing polypeptides comprising or consisting of above mentioned sequences, e.g. the polypeptide of the present invention or fragment thereof, Preferred are monoclonal antibodies, specifically binding to polypeptide as indicated in Table II, columns 5 or 7, lines 16 to 18 and/or lines 356 to 362.

In one embodiment, the present invention relates to a polypeptide having the amino acid sequence encoded by a nucleic acid molecule of the invention or the nucleic acid molecule used in the method of the invention or obtainable by a process of the invention. Said polypeptide confers preferably the aforementioned activity, in particular, the polypeptide confers the increase of the respective fine chemical in a cell or an organism or a part thereof after increasing the cellular activity, e.g. by increasing the expression or the specific activity of the polypeptide.

In one embodiment, the present invention relates to a polypeptide having a sequence as indicated in Table II, columns 5 or 7, lines 16 to 18 and/or lines 356 to 362 or as encoded by a nucleic acid molecule as indicated in Table I, columns 5 or 7, lines 16 to 18 and/or lines 356 to 362 or functional homologues thereof.

In one advantageous embodiment, in the method of the present invention the activity of a polypeptide is increased which comprises or consists of a consensus sequence as indicated in Table IV, column 7, lines 16 to 18 and/or lines 356 to 362 and in one another embodiment, the present invention relates to a polypeptide comprising or consisting of a consensus sequence as indicated in Table IV, column 7, lines 16 to 18 and/or lines 356 to 362 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid or, in an further embodiment, can be replaced and/or absent. In one embodiment, the present invention relates to the method of the present invention comprising a polypeptide or to a polypeptide comprising more than one consensus sequences as indicated in Table IV, column 7, lines 16 to 18 and/or lines 356 to 362.

amino acidamino acid

In one embodiment not more than 15%, preferably 10%, even more preferred 5%, 4%, 3%, or 2%, most preferred 1% or 0% of the amino acid position indicated by a letter are/is replaced another amino acid or, in an other embodiment, are/is absent and/or replaced. In another embodiment the stretches of non-conserved amino acids, indicated by $(X)_n$ [whereas n indicates the number of X], vary in their length by 20%, preferably by 15 or 10%, even more preferred by 5%, 4%, 3%, 2% or most preferred by only 1%.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence or, in an other embodiment, are absent and/or replaced.

The consensus sequence shown herein was derived from a multiple alignment of the sequences as listed in table II. The consensus sequences of specified domains were derived from a multiple alignment of all sequences. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. YX(21-23)F means that conserved tyrosine and phenylalanine residues are separated from each other by minimum 21 and maximum 23 amino acid residues in all investigated sequences.

The alignment was performed with the Software AlignX (sept 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penality: 10.0; gap extension penalty 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 0.9. Presettings were selected to allow also for the alignment of conserved amino acids.

In one advantageous embodiment, the method of the present invention comprises the increasing of a polypeptide comprising or consisting of plant or microorganism specific consensus sequences.

Accordingly, in one embodiment, the present invention relates to a polypeptide comprising or consisting of plant or microorganism specific consensus sequences. In one embodiment, said polypeptide of the invention distinguishes over a sequence as indicated in Table II A or IIB, columns 5 or 7, lines 16 to 18 and/or lines 356 to 362 by one or more amino acids. In one embodiment, polypeptide distinguishes form a sequence as indicated in Table II A or IIB, columns 5 or 7, lines 16 to 18 and/or lines 356 to 362 by more than 1, 2, 3, 4, 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from a sequence as indicated in Table II A or II B, columns 5 or 7, lines 16 to 18 and/or lines 356 to 362 by not more than 80% or 70% of the amino acids, preferably not more than 60% or 50%, more preferred not more than 40% or 30%, even more preferred not more than 20% or 10%. In an other embodiment, said polypeptide of the invention does not consist of a sequence as indicated in Table II A or II B, columns 5 or 7, lines 16 to 18 and/or lines 356 to 362.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to polypeptide conferring an increase in the respective fine chemical in an organism or part being encoded by the nucleic acid molecule of the invention or by a nucleic acid molecule used in the process of the invention.

In one embodiment, the polypeptide of the invention has a sequence which distinguishes from a sequence as indicated in Table II A or II B, columns 5 or 7, lines 16 to 18 and/or lines 356 to 362 by one or more amino acids. In an other embodiment, said polypeptide of the invention does not consist of the sequence as indicated in Table II A or II B, columns 5 or 7, lines 16 to 18 and/or lines 356 to 362. In a further embodiment, said polypeptide of the present invention is less than 100%, 99.999%, 99.99%, 99.9% or 99% identical. In one embodiment, said polypeptide does not consist of the sequence encoded by a nucleic acid molecules as indicated in Table I A or IB, columns 5 or 7, lines 16 to 18 and/or lines 356 to 362.

In one embodiment, the present invention relates to a polypeptide having an activity of a protein as indicated in Table II, column 3, lines 16 to 18 and/or lines 356 to 362, which distinguishes over a sequence as indicated in Table II A or II B, columns 5 or 7, lines 16 to 18 and/or lines 356 to 362 by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, poly-peptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized.

The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention-chemicals, more preferably less than about 20% chemical precursors or non-polypeptide of the invention-chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

Non-polypeptide of the invention-chemicals are e.g. polypeptides having not the activity and/or amino acid sequence of a polypeptide indicated in Table II, columns 3, 5 or 7, lines 16 to 18 and/or lines 356 to 362.

A polypeptide of the invention can participate in the process of the present invention. The polypeptide or a portion thereof comprises preferably an amino acid sequence which is sufficiently homologous to an amino acid sequence as indicated in Table II, columns 5 or 7, lines 16 to 18 and/or lines 356 to 362 such that the protein or portion thereof maintains the ability to confer the activity of the present invention. The portion of the protein is preferably a biologically active portion as described herein. Preferably, the polypeptide used in the process of the invention has an amino acid sequence identical to a sequence as indicated in Table II, columns 5 or 7, lines 16 to 18 and/or lines 356 to 362.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the nucleotide sequence as indicated in Table I, columns 5 or 7, Hines 16 to 18 and/or lines 356 to 362. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence as indicated in Table I, columns 5 or 7, lines 16 to 18 and/or lines 356 to 362 or which is homologous thereto, as defined above.

Accordingly the polypeptide of the present invention can vary from a sequence as indicated in Table II, columns 5 or 7, lines 16 to 18 and/or lines 356 to 362 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of a sequence as indicated in Table IIA or IIB, columns 5 or 7, lines 16 to 18 and/or lines 356 to 362.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention or used in the process of the present invention, e.g., an amino acid sequence as indicated in Table II, columns 5 or 7, lines 16 to 18 and/or lines 356 to 362 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of a protein having essentially the activity of the polypeptides as indicated in Table II, column 3, lines 16 to 18 and/or lines 356 to 362 but having differences in the sequence from said wild-type protein. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention or the polypeptide used in the method of the invention may be utilized to generate plants or parts thereof, expressing one or more wildtype protein(s) or one or more mutated protein encoding nucleic acid molecule(s) or polypeptide molecule(s) of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition comprising the respective fine chemical or a recovered respective fine chemical, in particular, the fine chemical, free or in protein-bound form.

Preferably, the compound is a composition comrising the tryptophane or a recovered tryptophane, in particular, the fine chemical, free or in protein-bound form.

The invention also provides chimeric or fusion proteins. As used herein, an "chimeric protein" or "fusion protein" comprises an polypeptide operatively linked to a polypeptide which does not confer above-mentioned activity, in particular, which does not confer an increase of content of the respective fine chemical in a cell or an organism or a part thereof, if its activity is increased.

In one embodiment, a reference to a "protein (=polypeptide)" of the invention or as indicated in Table II, columns 5 or 7, lines 16 to 18 and/or lines 356 to 362 refers to a polypeptide having an amino acid sequence corresponding to the polypeptide of the invention or used in the process of the invention, whereas a "non-polypeptide of the invention" or "other polypeptide"-not being indicated in Table II, columns 5 or 7, lines 16 to 18 and/or lines 356 to 362 refers to a polypeptide having an amino acid sequence corresponding to a protein which is not substantially homologous a polypeptide of the invention, preferably which is not substantially homologous to a as indicated in Table II, columns 5 or 7, lines 16 to 18 and/or lines 356 to 362 e.g., a protein which does not confer the activity described herein or annotated or known for as indicated in Table II, column 3, lines 16 to 18 and/or lines 356 to 362 and which is derived from the same or a different organism. In one embodiment a "non-polypeptide of the invention" or "other polypeptide" not being indicate in Table II, columns 5 or 7, lines 16 to 18 and/or lines 356 to 362 does not confer an increase of the fine chemical in an organism or part thereof.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a polypeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention or the nucleic acid molecule used in the method of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modelling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention or the polypeptide used in the method of the invention and its substrates or binding factors can be used for the identification or design of mutants with modulated binding or turn over activities. For example, the active centre of the polypeptide of the present invention can be modelled and amino acid residues participating in the catalytic reaction can be modulated to increase or decrease the binding of the substrate to activate or improve the polypeptide. The identification of the active centre and the amino acids involved in the catalytic reaction facilitates the screening for mutants having an increased activity.

The sequences shown in column 5 of the Tables I to IV herein have also been described under their Gene/ORF Locus Name as described in the Table I, II, III or IV, column 3.

In an especially preferred embodiment, the polypeptide according to the invention furthermore also does not have the sequences of those proteins which are encoded by the sequences shown in the known listed Gene/ORF Locus Names or as described in the Tables, column 3.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof.

The "anti-sense strand" contains an inverted sequence, which is complementary to that of the "sense strand".

In addition the expression levels and/or the activity can be modified by the introduction of mutations in the regulatory or coding regions of the nucleic acids of the invention. Furthermore antibodies can be expressed which specifically binds to a polypeptide of interest and thereby blocks it activity. The protein-binding factors can, for example, also be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention or the nucleic acid molecule used in the method of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5"-UTR or 3"-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule to the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention or the nucleic acid molecule used in the method of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methyl-inosine, 2,2-dimethylguanine, 2-methyladenine, 2-methylguanine, 3-methylcytosine, 5-methylcytosine, N6-adenine, 7-methylguanine, 5-methylaminomethyluracil, 5-meth-oxyaminomethyl-2-thiouracil, beta-D-mannosylqueosine, 5'-methoxycarboxymethyl-uracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy-acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention or the polypeptide used in the method of the invention having aforementioned the respective fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention or the nucleic acid molecule used in the method of the invention can be an α-anomeric nucleic acid molecule. An α-anomeric nucleic acid molecule forms specific double-stranded hybrids with complementary RNA in which, contrary to the usual units, the strands run parallel to each other (Gaultier et al. (1987) Nucleic Acids. Res. 15:6625-6641). The antisense nucleic acid molecule can also comprise a 2'-o-methyl-ribonucleotide (Inoue et al. (1987) Nucleic Acids Res. 15:6131-6148) or a chimeric RNA-DNA analogue (Inoue et al. (1987) FEBS Lett. 215:327-330).

Further the antisense nucleic acid molecule of the invention or the nucleic acid molecule used in the method of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) Nature 334:585-591)) can be used to catalytically cleave mRNA transcripts encoding the polypeptide of the invention or the polypeptide used in the method of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or the nucleic acid molecule used in the method of the invention or coding a protein used in the process of the invention or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J. W. (1993) Science 261:1411-1418.

The antisense molecule of the present invention comprises also a nucleic acid molecule comprising a nucleotide sequences complementary to the regulatory region of an nucleotide sequence encoding the natural occurring polypeptide of the invention or the polypeptide used in the method of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6): 569-84; Helene, C. et al. (1992) *Ann. N.Y. Acad. Sci.* 660:27-36; and Maher, L. J. (1992) *Bioassays* 14(12): 807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as *Neurospora, zebrafish, Drosophila*, mice, planaria, humans, *Trypanosoma*, petunia or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of a nucleic acid sequences as indicated in Table II, columns 5 or 7, lines 16 to 18 and/or lines 356 to 362 and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived therefrom), bring about altered metabolic activity by the reduction in the expression of a nucleic acid sequences as indicated in Table I, columns 5 or 7, lines 16 to 18 and/or lines 356 to 362 and/or homologs thereof. In a double-stranded RNA molecule for reducing the expression of an protein encoded by a nucleic acid sequence of one of the sequences as indicated in Table I, columns 5 or 7, lines 16 to 18 and/or lines 356 to 362 and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in non-mammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence as indicated in Table I, columns 5 or 7, lines 16 to 18 and/or lines 356 to 362 or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence as indicated in Table I, columns 5 or 7, lines 16 to 18 and/or lines 356 to 362 or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extra-cellularly (for example into the interstitial space).

Advantageously the RNAi method leads to only a partial loss of gene function and therefore enables the skilled worker to study a gene dose effect in the desired organism and to fine tune the process of the invention. Furthermore it enables a person skilled in the art to study multiple functions of a gene.

Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the respective fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with *Agrobacteria*, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

*Agrobacteria* transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J and Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol. Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22 (2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the fine chemical in a cell or an organism or a part thereof, e.g. the nucleic acid molecule of the invention or the nucleic acid molecule used in the method of the invention, the nucleic acid construct of the invention, the antisense molecule of the invention, the vector of the invention or a nucleic acid molecule encoding the polypeptide of the invention, e.g. the polypeptide as indicated in Table II, columns 5 or 7, lines 16 to 18 and/or lines 356 to 362. Due to the above mentioned activity the fine chemical content in a cell or an organism is increased. For example, due to modulation or manipulation, the cellular activity of the polypeptide of the invention or the polypeptide used in the method of the invention or nucleic acid molecule of the invention or the nucleic acid molecule used in the method of the invention is increased, e.g. due to an increased expression or specific activity of the subject matters of the invention in a cell or an organism or a part thereof. In one embodiment transgenic for a polypeptide having an activity of a polypeptide as indicated in Table II, columns 5 or 7, lines 16 to 18 and/or lines 356 to 362 means herein that due to modulation or manipulation of the genome, an activity as annotated for a polypeptide as indicated in Table II, columns 3, lines 16 to 18 and/or lines 356 to 362, e.g. having a sequence as indicated in Table II, columns 5 or 7, lines 16 to 18 and/or lines 356 to 362 is increased in a cell or an organism or a part thereof. Examples are described above in context with the process of the invention.

"Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either a) the nucleic acid sequence, or
b) a genetic control sequence linked operably to the nucleic acid sequence, for example a promoter, or
c) (a) and (b)

are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of a promoter of a polypeptide of the invention with the corresponding protein-encoding sequence—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the respective fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the respective fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the above-mentioned plant genus, more preferred from abovementioned plants species.

Transgenic plants comprising the amino acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The amino acids produced in the process according to the invention may, however, also be isolated from the plant in the form of their free amino acids or bound in proteins. Amino acids produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention or the nucleic acid molecule used in the method of the invention.

In another embodiment, the present invention relates also to a transgenic microorganism comprising the nucleic acid molecule of the invention or the nucleic acid molecule used in the method of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced amino acid composition or the produced respective fine chemical is isolated.

In this manner, more than 50% by weight, advantageously more than 60% by weight, preferably more than 70% by weight, especially preferably more than 80% by weight, very especially preferably more than 90% by weight, of the fine chemicals produced in the process can be isolated. The resulting fine chemicals can, if appropriate, subsequently be further purified, if desired mixed with other active ingredients such as vitamins, amino acids, carbohydrates, antibiotics and the like, and, if appropriate, formulated.

In one embodiment, the fatty acid is the fine chemical.

The amino acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the amino acid composition produced or the fine chemical produced if desired and formulating the product with a pharmaceutical acceptable carrier or formulating the product in a form acceptable for an application in agriculture. A further embodiment according to the invention is the use of the amino acids produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus, Corynebacterium, Micrococcus, Brevibacterium, Rhodococcus, Nocardia, Caseobacter* or *Arthrobacter* or Gram-negative bacteria such as the genera *Escherichia, Flavobacterium* or *Salmonella* or yeasts such as the genera *Rhodotorula, Hansenula* or *Candida*. Particularly advantageous organisms are selected from the group of genera *Corynebacterium, Brevibacterium, Escherichia, Bacillus, Rhodotorula, Hansenula, Candida, Claviceps* or *Flavobacterium*. It is very particularly advantageous to use in the process of the invention microorganisms selected from the group of genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum (=Micrococcus glutamicum), Corynebacterium melassecola, Corynebacterium* sp. or *Escherichia coli*, specifically *Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing aromatic compound-containing fine chemicals, in particular the fine chemical, it is possible to use as aromat source organic aromatic-containing compounds such as, for example, benzene, naphthaline, indole, pyrrole, furen, oxazole, imidazole, thiophene, pyrridin, pyrrimidine or else organic aromatic compounds such as benzoic acid and chorismic, shikimic, aminobenzoic, kynurenic acids or pyridoxidal.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P. M. Rhodes, P. F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular L-tryptophane, L-methionine, L-threonine and/or L-lysine, normally have a dry matter content of from 7.5 to 25% by weight. Sugar-limited fermentation is additionally advantageous, at least at the end, but especially over at least 30% of the fermentation time. This means that the concentration of utilizable sugar in the fermentation medium is kept at, or reduced to, 0 to 3 g/l during this time. The fermentation broth is then processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the amino acid produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavourings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence as indicated in Table I, columns 5 or 7, lines 16 to 18 and/or lines 356 to 362, preferably of Table I B, column 7, lines 16 to 18 and/or lines 356 to 362 and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the fine chemical level in the host cells; and (f) identifying the nucleic acid molecule and its gene product which expression confers an increase in the fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In an other embodiment, the present invention relates to a method for the identification of a gene product conferring an increase in the respective fine chemical production in a cell, comprising the following steps:

(a) identifying nucleic acid molecules of an organism; which can contain a candidate gene encoding a gene product conferring an increase in the respective fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;

(b) introducing the candidate nucleic acid molecules in host cells, preferably in a plant cells or microorganisms, appropriate for producing the respective fine chemical;

(c) expressing the identified nucleic acid molecules in the host cells;

(d) assaying the respective fine chemical level in the host cells; and (e) identifying the nucleic acid molecule and its gene product which expression confers an increase in the respective fine chemical level in the host cell after expression compared to the wild type.

Eventually gene products conferring the increase in the respective fine chemical production can also be identify according to a identical or similar 3D structure in step (a) and by the above described method.

The nucleic acid molecules identified can then be used for the production of the respective fine chemical in the same way as the nucleic acid molecule of the present invention. Accordingly, in one embodiment, the present invention relates to a process for the production of the respective fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the respective fine chemical to said plant comprising:

a) contacting cells which express the polypeptide of the present invention or its mRNA with a candidate compound under cell cultivation conditions;

b) assaying an increase in expression of said polypeptide or said mRNA;

c) comparing the expression level to a standard response made in the absence of said candidate compound; whereby, an increased expression over the standard indicates that the compound is stimulating production of the respective fine chemical.

Furthermore, in one embodiment, the present invention relates to a method for the screening for agonists or an antagonist of the activity of the polypeptide of the present invention or used in the process of the present invention, e.g. a polypeptide conferring an increase of the respective fine chemical in an organism or a part thereof after increasing the activity in an organism or a part thereof, comprising:

(a) contacting cells, tissues, plants or microorganisms which express the polypeptide according to the invention with a candidate compound or a sample comprising a plurality of compounds under conditions which permit the expression the polypeptide of the present invention or used in the process of the present invention;

(b) assaying the respective fine chemical level or the polypeptide expression level in the cell, tissue, plant or microorganism or the media the cell, tissue, plant or microorganisms is cultured or maintained in; and (c) identifying a agonist or antagonist by comparing the measured the respective fine chemical level or polypeptide of the invention or used in the invention expression level with a standard the respective fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to process for the identification of a compound conferring increased the respective fine chemical production in a plant or microorganism, comprising the steps:

(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and (b) identifying if the compound is an effective agonist by detecting the presence or absence or increase of a signal produced by said readout system.

The screen for a gene product or an agonist conferring an increase in the respective fine chemical production can be performed by growth of an organism for example a microorganism in the presence of growth reducing amounts of an inhibitor of the synthesis of the respective fine chemical. Better growth, e.g. higher dividing rate or high dry mass in comparison to the control under such conditions would identify a gene or gene product or an agonist conferring an increase in fine chemical production.

One can think to screen for increased production of the fine chemical by for example searching for a resistance to a drug blocking the synthesis of the fine chemical and looking whether this effect is dependent on the activity or expression of a polypeptide as indicated in Table II, columns 5 or 7, lines 16 to 18 and/or lines 356 to 362 or a homolog thereof, e.g. comparing the phenotype of nearly identical organisms with low and high activity of a protein as indicated in Table II, columns 5 or 7, lines 16 to 18 and/or lines 356 to 362 after incubation with the drug.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the respective fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the respective fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the arm, e.g. buffers and solutions for hydridization assays, e.g. the aforementioned solutions and buffers, further and means for Southern-, Western-, Northern—etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the respective fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or the polypeptide used in the method of the invention or comprising the steps of the method according to the invention for the identification of said compound, agonist or antagonist; and formulating the nucleic acid molecule, the vector or the polypeptide of the invention or the polypeptide used in the method of the invention or the agonist, or compound identified according to the methods or processes of the present invention or with use of the subject matters of the present invention in a form applicable as plant agricultural composition.

In another embodiment, the present invention relates to a method for the production of a "the respective fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the respective fine chemical production as mentioned and related organisms; mapping of genomes; identification and localization of sequences of interest; evolutionary studies; determination of regions required for function; modulation of an activity.

The nucleic acid molecule of the invention, the vector of the invention or the nucleic acid construct of the invention may also be useful for the production of organisms resistant to inhibitors of the amino acid production biosynthesis pathways. In particular, the overexpression of the polypeptide of the present invention may protect plants against herbicides, which block the amino acid, in particular the fine chemical, synthesis in said plant. Examples of herbicides blocking the amino acid synthesis in plants are for example sulfonylurea and imidazolinone herbicides which catalyze the first step in branched-chain amino acid biosynthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention or the nucleic acid molecule used in the method of the invention may be sufficiently homologous to the sequences of related species such that these nucleic acid molecules may serve as markers for the construction of a genomic map in related organism.

Accordingly, the present invention relates to a method for breeding plants for the production of the respective fine chemical, comprising
(a) providing a first plant variety produced according to the process of the invention preferably (over)expressing the nucleic acid molecule of the invention or the nucleic acid molecule used in the method of the invention;
(b) crossing the first plant variety with a second plant variety; and
(c) selecting the offspring plants which overproduce the respective fine chemical by means of analysis the distribution of a molecular marker in the offspring representing the first plant variety and its capability to (over) produce the respective fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention or the nucleic acid molecule used in the method of the invention and/or its expression level. Accordingly, the molecular marker can be a probe or a PCR primer set useful for identification of the genomic existence or genomic localisation of the nucleic acid molecule of the invention or the nucleic acid molecule used in the method of the invention, e.g. in a Southern blot analysis or a PCR or its expression level, i.g. in a Northern Blot analysis or a quantitative PCR.

Accordingly, in one embodiment, the present invention relates to the use of the nucleic acid molecule of the present invention or encoding the polypeptide of the present invention as molecular marker for breeding, especially for breeding for a high or low respective fine chemical production.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention or the nucleic acid molecule used in the method of the invention can be used for the identification of other nucleic acids conferring an increase of the respective fine chemical after expression.

Further, the nucleic acid molecule of the invention or the nucleic acid molecule used in the method of the invention or a fragment of a gene conferring the expression of the polypeptide of the invention or the polypeptide used in the method of the invention, preferably comprising the nucleic acid molecule of the invention, can be used for marker assisted breeding or association mapping of the respective fine chemical derived traits Accordingly, the nucleic acid of the invention, the polypeptide of the invention, the nucleic acid construct of the invention, the organisms, the host cell, the microorgansims, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other amino acids, in particular methionine, threonine, alanine, glutamine, glutamic acid, valine, asparagine, phenylalanine, leucine, proline, Tryptophan tyrosine, isoleucine and arginine.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the fine chemical in a organism or part thereof, e.g. in a cell.

Further, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist or the agonist identified with the method of the invention, the antibody of the present invention, the antisense molecule of the present invention or the nucleic acid molecule identified with the method of the present invention, can be used for the preparation of an agricultural composition.

Furthermore, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, antagonist or the agonist identified with the method of the invention, the antibody of the present invention, the antisense molecule of the present invention or the nucleic acid molecule identified with the method of the present invention, can be used for the identification and production of compounds capable of conferring a modulation of the respective fine chemical levels in an organism or parts thereof, preferably to identify and produce compounds conferring an increase of the respective fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nlm.nih.gov/PubMed/medline.html. Further databases and addresses, such as hftp://www.ncbi.nlm.nih.gov/, hftp://www.infobiogen.fr/, http://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.

---

1) Increase of the metabolites:
   Max: maximal x-fold (normalised to wild type)-
   Min: minimal x-fold (normalised to wild type)
2) Decrease of the metabolites:
   Max: maximal x-fold (normalised to wild type) (minimal decrease)
   Min: minimal x-fold (normalised to wild type) (maximal decrease)

---

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning SEQ ID No: 732 in *Escherichia coli*

A DNA polynucleotide with a sequence as indicated in Table I, column 5 and encoding a polypeptide as listed in Table 1 below, was cloned into the plasmids pBR322 (Sutcliffe, J. G. (1979) Proc. Natl. Acad. Sci. USA, 75: 3737-3741); pACYC177 (Change & Cohen (1978) J. Bacteriol. 134: 1141-1156); plasmids of the pBS series (pBSSK+, pBSSK– and others; Stratagene, LaJolla, USA) or cosmids such as SuperCosi (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of *Haemophilus Influenzae* Rd., Science 269; 496-512)".

Example 3

In-Vivo and In-Vitro Mutagenesis

An in vivo mutagenesis of *Corynebacterium glutamicum* for the production of the respective fine chemical can be carried out by passing a plasmid DNA (or another vector DNA) through *E. coli* and other microorganisms (for example *Bacillus* spp. or yeasts such as *Saccharomyces cerevisiae*), which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromo-uracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. Dpnl site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired respective fine chemical.

Example 4

DNA Transfer Between *Escherichia coli* and *Corynebacterium glutamicum*

Several *Corynebacterium* and *Brevibacterium* species comprise endogenous plasmids (such as, for example, pHM1519 or pBL1) which replicate autonomously (for a review, see, for example, Martin, J. F. et al. (1987) Biotechnology 5: 137-146). Shuttle vectors for *Escherichia coli* and *Corynebacterium glutamicum* can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), which have a replication origin for, and suitable marker from, *Corynebacterium glutamicum* added. Such replication origins are preferably taken from endogenous plasmids, which have been isolated from *Corynebacterium* and *Brevibacterium* species. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim). There are many examples in the literature of the preparation of a large multiplicity of shuttle vectors which are replicated in *E. coli* and *C. glutamicum* and which can be used for various purposes including the overexpression of genes (see, for example, Yoshihama, M. et al. (1985) J. Bacteriol. 162: 591-597, Martin, J. F. et al., (1987) Biotechnology, 5: 137-146 and Eikmanns, B. J. et al. (1992) Gene 102: 93-98). Suitable vectors, which replicate in coryneform bacteria are, for example, pZ1 (Menke) et al., Appl. Environ. Microbiol., 64, 1989: 549-554) pEkEx1 (Eikmanns et al., Gene 102, 1991: 93-98) or pHS2-1 (Sonnen et al, Gene 107, 1991: 69-74). These vectors are based on the cryptic plasmids pHM1519, pBL1 or pGA1. Other plasmid vectors such as, for example, those based on pCG4 (U.S. Pat. No. 4,489,160), pNG2 (Serwold-Davis et al., FEMS Microbiol. Lett., 66, 1990: 119-124) or pAG1 (U.S. Pat. No. 5,158,891) can be used in the same manner.

Using standard methods, it is possible to clone a gene of interest into one of the above-described shuttle vectors and to introduce such hybrid vectors into *Corynebacterium glutamicum* strains. The transformation of *C. glutamicum* can be achieved by protoplast transformation (Kastsumata, R. et al., (1984) J. Bacteriol. 159, 306-311), electroporation (Liebl, E. et al., (1989) FEMS Microbiol. Letters, 53: 399-303) and in those cases where specific vectors are used also by conjugation (such as, for example, described in Schäfer, A., et al. (1990) J. Bacteriol. 172: 1663-1666). Likewise, it is possible to transfer the shuttle vectors for *C. glutamicum* to *E. coli* by preparing plasmid DNA from *C. glutamicum* (using standard methods known in the art) and transforming it into *E. coli*. This transformation step can be carried out using standard methods, but preferably using an Mcr-deficient *E. coli* strain, such as NM522 (Gough & Murray (1983) J. Mol. Biol. 166: 1-19).

If the transformed sequence(s) is/are to be integrated advantageously into the genome of the coryneform bacteria, standard techniques known to the skilled worker also exist for this purpose. Examples, which are used for this purpose are plasmid vectors as they have been described by Remscheid et al. (Appl. Environ. Microbiol., 60, 1994: 126-132) for the duplication and amplification of the hom-thrB operon. In this method, the complete gene is cloned into a plasmid vector which is capable of replication in a host such as *E. coli*, but not in *C. glutamicum*. Suitable vectors are, for example, pSUP301 (Simon et al., Bio/Technology 1, 1983: 784-791), pK18mob or pK19mob (Schäfer et al., Gene 145, 1994: 69-73), pGEM-T (Promega Corp., Madison, Wis., USA), pCR2.1-TOPO (Schuman, J. Biol. Chem., 269, 1994: 32678-32684, U.S. Pat. No. 5,487,993), pCR®Blunt (Invitrogen, Groningen, the Netherlands) or pEM1 (Schrumpf et al., J. Bacteriol., 173, 1991: 4510-4516).

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* or other microorganisms by a variety of methods, which are known in the art, e.g. as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicates the presence and the amount of the sought mutant protein in the cell. However, other methods are also known.

Example 6

Growth of Genetically Modified *Corynebacterium glutamicum*: Media and Culture Conditions Genetically modified *Corynebacteria* are grown in synthetic or natural growth media. A number of different growth media for *Corynebacteria* are known and widely available (Lieb et al. (1989) Appl. Microbiol. Biotechnol. 32: 205-210; von der Osten et al. (1998) Biotechnology Letters 11: 11-16; Patent DE 4 120 867; Liebl (1992) "The Genus *Corynebacterium*", in: The Procaryotes, Vol. II, Balows, A., et al., Ed. Springer-Verlag).

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as $NH_4Cl$, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar and 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously.

The culture pH value may also be kept constant during the culture period by addition of, for example, NaOH or NH$_4$OH. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by introducing of a preculture of seed organisms.

For example, the media are inoculated by introducing of a saline solution of *C. glutamicum* cells from CM plates or by addition of a liquid preculture of this bacterium.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N.C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 8

Analysis of the Effect of the Nucleic Acid Molecule on the Production of the Amino Acids The effect of the genetic modification in *C. glutamicum* on the production of an amino acid can be determined by growing the modified microorganisms under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Better, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 9

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 732 for the Expression in Plants

Unless otherwise specified, standard methods as described in Sambrook et al., Molecular Cloning: A laboratory manual, Cold Spring Harbor 1989, Cold Spring Harbor Laboratory Press are used.

SEQ ID NO: 732 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Pfu Turbo DNA polymerase. The amplification cycles were as follows:

1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C. The composition for the protocol of the Herculase polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Herculase polymerase. The amplification cycles were as follows:

1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID No: 732:
i) forward primer (SEQ ID No: 734)
ATGGATAGTACGAATTTGAACAAACG
ii) reverse primer (SEQ ID No: 735)
TTAGAGTATTTCCAGATCTGAATCTG Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector. The PCR-products, produced by Pfu Turbo DNA polymerase, were phosphorylated using a T4 DNA polymerase using a standard protocol (e.g. MBI Fermentas) and cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well. The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID No: 732

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000) "A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The *agrobacteria* generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1 000 seeds per dish. The dishes were covered with a hood and placed in the stratification facility (8 h, 110μ, μmol/m$^2$/s$^{-1}$, 22° C.; 16 h, dark, 6° C.). After 5 days, the dishes were placed into the short-day controlled environment chamber (8 h 130 μmol/m$^2$/s$^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 μE, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 μl Silwett L77 (Crompton S. A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the described changes in comparison with wild-types were caused by the introduced genes.

As an alternative, the amino acids can be detected advantageously via HPLC separation in ethanolic extract as described by Geigenberger et al. (Plant Cell & Environ, 19, 1996: 43-55).

The results of the different plant analyses can be seen from the table which follows:

TABLE 1

| ORF | Annotation | Metabolite | Min | Max | Method |
|---|---|---|---|---|---|
| YER173W | Checkpoint protein, involved in the activation of the DNA damage and meiotic pachytene checkpoints | Tryptophane | 1.27 | 2.78 | LC |
| YGR104C | RNA polymerase II suppressor protein SRB5 - yeast; Suppressor of RNA polymerase B SRB5 | Tryptophane | 1.32 | 1.84 | LC |
| b0186 | lysine decarboxylase | Tryptophane | 1.32 | 2.46 | LC |

TABLE 1b

| ORF | MetChemID | Metabolite | Method | Min | Max |
|---|---|---|---|---|---|
| b0161 | 10000035 | Tryptophane | LC | 1.93 | 3.78 |
| b0486 | 10000035 | Tryptophane | LC | 1.42 | 4.35 |
| b1318 | 10000035 | Tryptophane | LC | 2.36 | 4.30 |
| b2270 | 10000035 | Tryptophane | LC | 1.33 | 1.79 |

TABLE 1b-continued

| ORF | MetChemID | Metabolite | Method | Min | Max |
|---|---|---|---|---|---|
| b3074 | 10000035 | Tryptophane | LC | 1.33 | 1.79 |
| b3983 | 10000035/ 30000016 | Tryptophane | LC + GC | 1.33 | 4.87 |
| YHR189W | 10000035 | Tryptophane | LC | 1.31 | 1.66 |

Column 3 shows the metabolite/respective fine chemical analyzed. Columns 4 and 5 shows the ratio of the analyzed metabolite/respective fine chemical between the transgenic plants and the wild type; Increase of the metabolites: Max: maximal x-fold (normalised to wild type)-Min: minimal x-fold (normalised to wild type). Decrease of the metabolites: Max: maximal x-fold (normalised to wild type) (minimal decrease), Min: minimal x-fold (normalised to wild type) (maximal decrease). Column 6 indicates the analytical method.

When the analyses were repeated independently, all results proved to be significant.

Example 14a

Engineering Ryegrass Plants by Over-Expressing the Polynucleotide Characterized in the Invention, e.g. Derived from *Saccharomyces cerevisiae*, *E. coli* or Plants or an Other Organism Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 µm in size) are coated with plasmid DNA according to method of Sanford et al., 1993 and are delivered to the embryogenic callus with the following parameters: 500 µg particles and 2 µg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14b

Engineering Soybean Plants by Over-Expressing the Polynucleotide Characterized in the Invention, e.g. Derived from *Saccharomyces cerevisiae*, *E. coli* or Plants or Another Organism Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 µE–m–2s–1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1 agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing the Polynucleotide Characterized in the Invention, e.g. Derived from *Saccharomyces cerevisiae*, *E. coli* or Plants or Another Organism Amplification of for example SEQ ID NO: 1 was achieved as described in example 10 except that the upstream primer SEQ ID NO:3 and the reverse primer SEQ ID NO: 4 contained the following 5"extensions:
  i) forward primer: 5"-GGGTCGCTCCTACGCG-3" SEQ ID NO: 68243
  ii) reverse primer 5"-CTCGGGCTCGGCGTCC-3" SEQ ID NO: 68246
Vector Construction The maize transformation vector for constitutive expression was constructed as follows.

As base vectors, the vectors EG073qcz (SEQ ID NO 68240) and EG065qcz (SEQ ID NO: 68241) were chosen. The MCS from EG065qcz was deleted by digestion of the vector with Asp718 and PstI, followed by blunting of the vector using T4 DNA polymerase. The blunted vector was religated. The vector generated was called EG065-MCS. The LIC cassette was cloned in the vector EG065-MCS by hybridizing the following oligos, generating a DNA fragment with ends able to ligate into a SmaI and SacI digested vector. This fragment was ligated into the vector EG065-MCS that had been digested with SmaI and SacI. The generated vector was called EG065-LIC. The complete expression cassette comprising ScBV (Schenk (1999) Plant Mol Biol 39(6):1221-1230) promoter, LIC cassette and terminator was cut out of EG065-LIC with AscI and PacI and ligated into the vector EG073qcz that had previously been digested with AscI and PacI. The resulting binary vector for corn transformation was called pMME0607 (SEQ ID NO: 68242).
Oligo POCCLicMluISacIIfw: gggtcgctcctacgcgtcaatgatc-cgcggacgccgagcccgagct (SEQ ID NO: 68244)
Oligo POCCLicMluISacIrev: cgggctcggcgtccgcggatcat-tgacgcgtaggagcgaccc (SEQ ID NO: 68245)

For cloning of a polynucleotide of the invention, for example the ORF of SEQ ID NO: 1, from *S. cerevisiae* the vector DNA was treated with the restriction enzyme MluI and SacII. The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 14c.a

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of *agrobacterium* for around 30 minutes. Excised embryos were removed from liquid and then co-cultivated in the dark at 22° C. with *Agrobacterium tumefaciens* on solid MS-based callus induction medium containing 2 mg/l 2,4-D, 10 um AgNO3, and 200 um Acetosyringone. After several days of co-cultivation, embryos were transferred to MS-based media containing 2 mg/l 2,4, 10 um AgNO3 and 200 mg/l Timentin the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 uE/m2/s−1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s−1. After plants were grown to 4-6 leaf stage they were moved to 14 inch pots containing Metro-Mix® 360. Supplemental metal-halide lamps were used to maintain >800uE/m2/s−1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

Example 14c.b

Growth of T0 Corn Plants for Metabolic Analysis

Plants were grown under the following standardized conditions to properly stage them for T0 sampling. T0 plantlets were transferred to 14" pots in the greenhouse after they grow to 4-6 leaf stage (1-3 weeks). pBSMM232 containing plants were produced carried along with each experiment to serve as controls for T0 samples. Plantlets were moved to 14" pots on Tuesday of each week. Plants were grown for 9 days until the 7-13 leaf stage is reached. On Thursday between 10 am and 2 pm leaf sampling was performed on the 3rd youngest ($1^{st}$ fully elongated). Within 30 seconds 250-500 mg of leaf material (without midrib), were removed weighed and placed into pre-extracted glass thimbles in liquid nitrogen. A second sample (opposite side of the midrib) from each plant was sampled as described above for qPCR analysis.

Example 14c.c

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 7 days old, they were subjected to select transgenic plants. For this purposes pieces of plant leaves were sampled and a PCR reaction with the respective primers for the transgene were performed. Plants exhibiting the transgene were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Example 14c.d

Metabolic Analysis of Maize Leaves

The modifications identified in accordance with the invention, in the content of above-described metabolites, were identified by the following procedure.
a) Sampling and Storage of the Samples Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen. The time elapsing between cutting the leave to freezing it in liquid nitrogen amounted to not more than 30 seconds. The boxes were stored in a freezer at −80° C., an shipped on dry ice.
b) Lyophilization During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar.

After the vacuum pump and the refrigerating machine had been switched off, the system was flushed with air (dried via a drying tube) or argon.
c) Extraction Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-decanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.
d) Processing the Lipid Phase for the LC/MS or LC/MS/MS Analysis The lipid extract, which had been evaporated to dryness was taken up in mobile phase. The HPLC was run with gradient elution.

The polar extract, which had been evaporated to dryness was taken up in mobile phase. The HPLC was run with gradient elution.
e) Derivatization of the Lipid Phase for the GC/MS Analysis For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (20 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Transformation of maize (Zea Mays L.) can also be performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673 can be used to provide constitutive expression of the trait gene.

Excised embryos can be grown on callus induction medium, then maize regeneration medium, containing imidazolinone as a selection agent. The Petri plates can be incubated in the light at 25° C. for 2-3 weeks, or until shoots develop. The green shoots can be transferred from each embryo to maize rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which can be PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants can exhibited similar phenotypes as the T1 plants. Hybrid plants (F1 progeny) of homozygous transgenic plants and non-transgenic plants can also exhibit increased similar phenotypes.

Example 14d

Engineering Wheat Plants by Over-Expressing the Polynucleotide Characterized in the Invention, e.g. Derived from *Saccharomyces cerevisiae*, *E. Coli* or Plants or Another Organism Transformation of wheat can be performed with the method described by Ishida et al. (1996 Nature Biotech. 14745-50). The cultivar Bobwhite (available from CYMMIT, Mexico) can commonly be used in transformation. Immature embryos can be co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

After incubation with *Agrobacterium*, the embryos can be grown on callus induction medium, then regeneration medium, containing imidazolinone as a selection agent. The Petri plates can be incubated in the light at 25° C. for 2-3 weeks, or until shoots develop. The green shoots can be transferred from each embryo to rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants exhibited similar phenotypes.

Example 14e

Engineering Rapeseed/Canola Plants by Over-Expressing the Polynucleotide Characterized in the Invention, e.g. Derived from *Saccharomyces cerevisiae*, *E. coli* or Plants or Another Organism Cotyledonary petioles and hypocotyls of 5-6 day-old young seedlings can be used as explants for tissue culture and transformed according to Babic et al. (1998, Plant Cell Rep 17: 183-188). The commercial cultivar Westar (Agriculture Canada) can be the standard variety used for transformation, but other varieties can be used.

*Agrobacterium tumefaciens* LBA4404 containing a binary vector can be used for canola transformation. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767, 366 and 6,225,105). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

Canola seeds can be surface-sterilized in 70% ethanol for 2 min., and then in 30% Clorox with a drop of Tween-20 for 10 min., followed by three rinses with sterilized distilled water. Seeds can be then germinated in vitro 5 days on half strength MS medium without hormones, 1% sucrose, 0.7% Phytagar at 23° C., 16 hr. light. The cotyledon petiole explants with the cotyledon attached can be excised from the in vitro seedlings, and can be inoculated with *Agrobacterium* by dipping the cut end of the petiole explant into the bacterial suspension. The explants can be then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants can be transferred to MSBAP-3 medium containing 3 mg/l BAP, cefotaxime, carbenicillin, or timentin (300 mg/l) for 7 days, and can then be cultured on MSBAP-3 medium with cefotaxime, carbenicillin, or timentin and selection agent until shoot regeneration. When the shoots are 5-10 mm in length, they can be cut and transferred to shoot elongation medium (MSBAP-0.5, containing 0.5 mg/l BAP). Shoots of about 2 cm in length can be transferred to the rooting medium (MS0) for root induction.

Samples of the primary transgenic plants (T0) can be analyzed by PCR to confirm the presence of T-DNA. These results can be confirmed by Southern hybridization in which DNA is electrophoresed on a 1 agarose gel and are transferred to a positively charged nylon membrane (Roche Diagnostics). The PCR DIG Probe Synthesis Kit (Roche Diagnostics) can be used to prepare a digoxigenin-labelled probe by PCR, and used as recommended by the manufacturer.

Example 14f

Engineering Alfalfa Plants by Over-Expressing the Polynucleotide Characterized in the Invention, e.g. Derived from *Saccharomyces cerevisiae* or *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) can be selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. The 34S promoter (GenBank Accession numbers M59930 and X16673) can be used to provide constitutive expression of the trait gene.

The explants can be cocultivated for 3 d in the dark on SH induction medium containing 288 mg/L Pro, 53 mg/L thioproline, 4.35 g/L K2SO4, and 100 μm acetosyringinone. The explants can be washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos can be transferred to BOi2Y development medium containing no growth regulators, no antibiotics, and 50 g/L sucrose. Somatic embryos are subsequently germinated on half-strength Murashige-Skoog medium. Rooted seedlings can be transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing the Polynucleotide Characterized in the Invention, Derived e.g. From *Saccharomyces cerevisiae, E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds.

Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Item 1. A process for the production of tryptophane, which comprises
  (a) increasing or generating the activity of a protein as indicated in Table II, columns 5 or 7, lines 16 to 18 and/or lines 356 to 362 or a functional equivalent thereof in a non-human organism, or in one or more parts thereof; and
  (b) growing the organism under conditions which permit the production of tryptophane in said organism.

Item 2. A process for the production of tryptophane, comprising the increasing or generating in an organism or a part thereof the expression of at least one nucleic acid molecule comprising a nucleic acid molecule selected from the group consisting of:
  (a) nucleic acid molecule encoding of a polypeptide as indicated in Table II, columns 5 or 7, lines 16 to 18 and/or lines 356 to 362 or a fragment thereof, which confers an increase in the amount of tryptophane in an organism or a part thereof;
  (b) nucleic acid molecule comprising of the nucleic acid molecule as indicated in Table I, columns 5 or 7, lines 16 to 18 and/or lines 356 to 362;
  (c) nucleic acid molecule whose sequence can be deduced from a polypeptide sequence encoded by a nucleic acid molecule of (a) or (b) as a result of the degeneracy of the genetic code and conferring an increase in the amount of tryptophane in an organism or a part thereof;
  (d) nucleic acid molecule which encodes a polypeptide which has at least 50% identity with the amino acid sequence of the polypeptide encoded by the nucleic acid molecule of (a) to (c) and conferring an increase in the amount of tryptophane in an organism or a part thereof;
  (e) nucleic acid molecule which hybidizes with a nucleic acid molecule of (a) to (c) under stringent hybridisation conditions and conferring an increase in the amount of tryptophane in an organism or a part thereof;
  (f) nucleic acid molecule which encompasses a nucleic acid molecule which is obtained by amplifying nucleic acid molecules from a cDNA library or a genomic library using the primers or primer pairs as indicated in Table III, column 7, lines 16 to 18 and/or lines 356 to 362 and conferring an increase in the amount of the fine chemical in an organism or a part thereof;
  (g) nucleic acid molecule encoding a polypeptide which is isolated with the aid of monoclonal antibodies against a polypeptide encoded by one of the nucleic acid molecules of (a) to (f) and conferring an increase in the amount of tryptophane in an organism or a part thereof;
  (h) nucleic acid molecule encoding a polypeptide comprising a consensus sequence as indicated in Table IV, column 7, lines 16 to 18 and/or lines 356 to 362 and conferring an increase in the amount of the fine chemical in an organism or a part thereof;
  (i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical in an organism or a part thereof.

or comprising a sequence which is complementary thereto.

Item 3. The process of item1 or 2, comprising recovering of the free or bound tryptophane.

Item 4. The process of any one of item 1 to 3, comprising the following steps:
  (a) selecting an organism or a part thereof expressing a polypeptide encoded by the nucleic acid molecule characterized in item 2;
  (b) mutagenizing the selected organism or the part thereof;
  (c) comparing the activity or the expression level of said polypeptide in the mutagenized organism or the part thereof with the activity or the expression of said polypeptide of the selected organisms or the part thereof;
  (d) selecting the mutated organisms or parts thereof, which comprise an increased activity or expression level of said polypeptide compared to the selected organism or the part thereof;
  (e) optionally, growing and cultivating the organisms or the parts thereof; and
  (f) recovering, and optionally isolating, the free or bound tryptophane produced by the selected mutated organisms or parts thereof.

Item 5. The process of any one of items 1 to 4, wherein the activity of said protein or the expression of said nucleic acid molecule is increased or generated transiently or stably.

Item 6. An isolated nucleic acid molecule comprising a nucleic acid molecule selected from the group consisting of:
  (a) nucleic acid molecule encoding of a polypeptide as indicated in Table II, columns 5 or 7, lines 16 to 18 and/or lines 356 to 362 or a fragment thereof, which confers an increase in the amount of tryptophane in an organism or a part thereof;
  (b) nucleic acid molecule comprising of a nucleic acid as indicated in Table I, columns 5 or 7, lines 16 to 18 and/or lines 356 to 362;

(c) nucleic acid molecule whose sequence can be deduced from a polypeptide sequence encoded by a nucleic acid molecule of (a) or (b) as a result of the degeneracy of the genetic code and conferring an increase in the amount of tryptophane in an organism or a part thereof;

(d) nucleic acid molecule which encodes a polypeptide which has at least 50% identity with the amino acid sequence of the polypeptide encoded by the nucleic acid molecule of (a) to (c) and conferring an increase in the amount of tryptophane in an organism or a part thereof;

(e) nucleic acid molecule which hybidizes with a nucleic acid molecule of (a) to (c) under stringent hybridisation conditions and conferring an increase in the amount of tryptophane in an organism or a part thereof;

(f) nucleic acid molecule which encompasses a nucleic acid molecule which is obtained by amplifying nucleic acid molecules from a cDNA library or a genomic library using the primers or primer pairs as indicated in Table III, 7, lines 16 to 18 and/or lines 356 to 362 and conferring an increase in the amount of tryptophane in an organism or a part thereof;

(g) nucleic acid molecule encoding a polypeptide which is isolated with the aid of monoclonal antibodies against a polypeptide encoded by one of the nucleic acid molecules of (a) to (f) and conferring an increase in the amount of tryptophane in an organism or a part thereof;

(h) nucleic acid molecule encoding a polypeptide comprising the consensus sequence as indicated in Table IV, column 7, lines 16 to 18 and/or lines 356 to 362 and conferring an increase in the amount of the fine chemical in an organism or a part thereof; and (i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical in an organism or a part thereof.

whereby the nucleic acid molecule distinguishes over the sequence as indicated in Table IA, columns 5 or 7, lines 16 to 18 and/or lines 356 to 362 by one or more nucleotides.

Item 7. A nucleic acid construct which confers the expression of the nucleic acid molecule of item 6, comprising one or more regulatory elements.

Item 8. A vector comprising the nucleic acid molecule as defined in item 6 or the nucleic acid construct of item 7.

Item 9. The vector as defined in item 8, wherein the nucleic acid molecule is in operable linkage with regulatory sequences for the expression in a prokaryotic or eukaryotic, or in a prokaryotic and eukaryotic host.

Item 10. A host cell, which has been transformed stably or transiently with the vector as defined in item 9 or 10 or the nucleic acid molecule as defined in item 6 or the nucleic acid construct of item 7 or produced as described in item any one of items 2 to 5.

Item 11. The host cell of item 10, which is a transgenic host cell.

Item 12. The host cell of item 10 or 11, which is a plant cell, an animal cell, a microorganism, or a yeast cell, a fungus cell, a prokaryotic cell, an eukaryotic cell or an archaebacterium.

Item 13. A process for producing a polypeptide, wherein the polypeptide is expressed in a host cell as defined in any one of items 10 to 12.

Item 14. A polypeptide produced by the process as defined in item 13 or encoded by the nucleic acid molecule as defined in item 6 whereby the polypeptide distinguishes over a sequence as indicated in Table II A, columns 5 or 7, lines 16 to 18 and/or lines 356 to 362 by one or more amino acids.

Item 15. An antibody, which binds specifically to the polypeptide as defined in item 14.

Item 16. A plant tissue, propagation material, harvested material or a plant comprising the host cell as defined in item 12 which is plant cell or an *Agrobacterium*.

Item 17. A method for screening for agonists and antagonists of the activity of a polypeptide encoded by the nucleic acid molecule of item 6 conferring an increase in the amount of tryptophane in an organism or a part thereof comprising:

(a) contacting cells, tissues, plants or microorganisms which express the a polypeptide encoded by the nucleic acid molecule of item 6 conferring an increase in the amount of tryptophane in an organism or a part thereof with a candidate compound or a sample comprising a plurality of compounds under conditions which permit the expression the polypeptide;

(b) assaying the tryptophane level or the polypeptide expression level in the cell, tissue, plant or microorganism or the media the cell, tissue, plant or microorganisms is cultured or maintained in; and (c) identifying a agonist or antagonist by comparing the measured tryptophane level or polypeptide expression level with a standard tryptophane or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Item 18. A method for the identification of a compound conferring increased tryptophane production in a plant or microorganism, comprising the steps:

a) culturing a plant cell or tissue or microorganism or maintaining a plant expressing the polypeptide encoded by the nucleic acid molecule of item 6 conferring an increase in the amount of tryptophane in an organism or a part thereof and a readout system capable of interacting with the polypeptide under suitable conditions which permit the interaction of the polypeptide with dais readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of item 6 conferring an increase in the amount of tryptophane in an organism or a part thereof;

b) identifying if the compound is an effective agonist by detecting the presence or absence or increase of a signal produced by said readout system.

Item 19. A method for the identification of a gene product conferring an increase in tryptophane production in a cell, comprising the following steps:

a) contacting the nucleic acid molecules of a sample, which can contain a candidate gene encoding a gene product conferring an increase in tryptophane after expression with the nucleic acid molecule of item 6;

b) identifying the nucleic acid molecules, which hybridise under relaxed stringent conditions with the nucleic acid molecule of item 6;

c) introducing the candidate nucleic acid molecules in host cells appropriate for producing tryptophane;
d) expressing the identified nucleic acid molecules in the host cells;
e) assaying the tryptophane level in the host cells; and
f) identifying nucleic acid molecule and its gene product which expression confers an increase in the tryptophane level in the host cell in the host cell after expression compared to the wild type.

Item 20. A method for the identification of a gene product conferring an increase in tryptophane production in a cell, comprising the following steps:
a) identifying in a data bank nucleic acid molecules of an organism; which can contain a candidate gene encoding a gene product conferring an increase in the tryptophane amount or level in an organism or a part thereof after expression, and which are at least 20% homolog to the nucleic acid molecule of item 6;
b) introducing the candidate nucleic acid molecules in host cells appropriate for producing tryptophane;
c) expressing the identified nucleic acid molecules in the host cells;
d) assaying the tryptophane level in the host cells; and
e) identifying nucleic acid molecule and its gene product which expression confers an increase in the tryptophane level in the host cell after expression compared to the wild type.

Item 21. A method for the production of an agricultural composition comprising the steps of the method of any one of items 17 to 20 and formulating the compound identified in any one of items 17 to 20 in a form acceptable for an application in agriculture.

Item 22. A composition comprising the nucleic acid molecule of item 6, the polypeptide of item 14, the nucleic acid construct of item 7, the vector of any one of item 8 or 9, an antagonist or agonist identified according to item 17, the compound of item 18, the gene product of item 19 or 20, the antibody of item 15, and optionally an agricultural acceptable carrier.

Item 23. Use of the nucleic acid molecule as defined in item 6 for the identification of a nucleic acid molecule conferring an increase of tryptophane after expression.

Item 24. Use of the polypeptide of item 14 or the nucleic acid construct item 7 or the gene product identified according to the method of item 19 or 20 for identifying compounds capable of conferring a modulation of tryptophane levels in an organism.

Item 25. Food or feed composition comprising the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 17, the host cell of item 10 to 12 or the gene product identified according to the method of item 19 or 20.

Item 26. Use of the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the host cell of item 10 to 12 or the gene product identified according to the method of item 19 or 20 for the protection of a plant against a tryptophane synthesis inhibiting herbicide.

The present invention relates to a process for the production of the fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

In a further embodiment, the present invention relates to a further process for the production of fine chemicals as defined below and corresponding embodiments as described herein as follows.

The present invention relates to a process for the production of a fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other substances described in Ullmann's Encyclopedia of Industrial Chemistry, vol. A2, pp. 57-97, VCH Weinheim, 1985.

Over one million tons of amino acids are currently produced annually; their market value amounts to over 2.5 billion US dollars. They are currently produced by four competing processes: Extraction from protein hydrolysates, for example L-cystine, L-leucine or L-tyrosine, chemical synthesis, for example of D-, L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is *Corynebacterium glutamicum*, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterized thoroughly; for a review of the bacterial amino acid biosynthesis and its regulation, see Umbarger, H. E. (1978) Ann. Rev. Biochem. 47: 533-606.

It is known that amino acids are produced by fermentation of strains of coryneform bacteria, in particular *Corynebacterium glutamicum*. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as *Escherichia* or *Bacillus* are also used for the production of amino acids. A number of mutant strains, which produce an assortment of desirable compounds from the group of the sulfur-containing fine chemicals, have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetylnorleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082,993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases special enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenesis of plant and selection afterwards with inhibitors of certain enzymes of amino acid biosynthetic pathway.

Methods of recombinant DNA technology have also been used for some years to improve *Corynebacterium* strains producing L-amino acids by amplifying individual amino acid biosynthesis genes and investigating the effect on amino acid production.

As described above, the essential amino acids are necessary for humans and many mammals, for example for livestock. Arginine is a semi-essential amino acid involved in multiple areas of human physiology and metabolism. It is not considered essential because humans can synthesize it de novo from glutamine, glutamate, and proline. However, dietary intake remains the primary determinant of plasma arginine levels, since the rate of arginine biosynthesis does not increase to compensate for depletion or inadequate supply. Dietary arginine intake regulates whole body arginine synthesis from proline in the neonatal piglet. The maximal rate of arginine synthesis (0.68 g/kg/d) is not enough to supply the whole body metabolic requirement for arginine in the young pig. In animals, glutamate functions as a neurotransmitter and activates glutamate receptor cation channels (iGluRs), which trigger electrical or $Ca^{2+}$ signal cascades. In plants, amino acids are involved in signalling of both plant nitrogen status and plant nitrogen:carbon ratios. Endogenous glutamine has been implicated in feedback inhibition of root N uptake, via the suppression of transcription of genes encoding inorganic nitrogen transporters (Rawat et al., Plant Journal 19: 143-152, 1999; Zhuo et al., Plant Journal 17: 563-568, 1999). The nonessential amino acid, proline, is synthesized from L-ornithine or L-glutamate. The proline from L-ornithine is linked to protein metabolism in the urea cycle and the proline from L-glutamate is linked to carbohydrate metabolism. Collagen is the major reservoir for proline in the body. Vitamin C should be used with proline for collagen problems.

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add a plurality of amino acids in a balanced manner to suit the organism.

It is an object of the present invention to develop an inexpensive process for the synthesis of arginine and/or glutamate and/or glutamine and/or proline, preferably L-arginine and/or L-glutamate and/or L-glutamine and/or L-proline.

It was now found that this object is achieved by providing the process according to the invention described herein and the embodiments characterized in the claims.

Accordingly, in a first embodiment, the invention relates to a process for the production of a fine chemical, whereby the fine chemical is arginine and/or glutamate and/or glutamine and/or proline, preferably L-arginine and/or L-glutamate and/or L-glutamine and/or L-proline. Accordingly, in the present invention, the term "the fine chemical" as used herein relates to "arginine and/or glutamate and/or glutamine and/or proline". Further, the term "the fine chemicals" as used herein also relates to fine chemicals comprising arginine and/or glutamate and/or glutamine and/or proline.

In one embodiment, the term "the fine chemical" means arginine and/or glutamate and/or glutamine and/or proline, preferably L-arginine and/or L-glutamate and/or L-glutamine and/or L-proline. Throughout the specification the term "the fine chemical" means arginine and/or glutamate and/or glutamine and/or proline, preferably L-arginine and/or L-glutamate and/or L-glutamine and/or L-proline, its salts, ester or amides in free form or bound to proteins. In a preferred embodiment, the term "the fine chemical" means arginine and/or glutamate and/or glutamine and/or proline, preferably L-arginine and/or L-glutamate and/or L-glutamine and/or L-proline, in free form or its salts or bound to proteins.

Accordingly, the present invention relates to a process comprising (a) increasing or generating the activity of one or more YDR316W, YHR130C, YKR057W, YNL090 W, b1829, b0695, b1284, b2095, b0161, b2307 and/or b3936—protein(s) or of a protein having the sequence of a polypeptide encoded by a nucleic acid molecule indicated in Table II, columns 5 or 7, lines 30 to 37, 390, 405 and/or 430;

in a non-human organism in one or more parts thereof and (b) growing the organism under conditions which permit the production of the fine chemical, meaning of arginine or fine chemicals comprising arginine in said organism;

or (a) increasing or generating the activity of one or more YBR204C, YFL013C, YGR104c, YPR024W, YPR133W-A, b0730, b0050, b0057, b0161, b1343, b1693, b1736, b1738, b1896, b2307, b2710, b2818, b3074, b3116, b3169, b3619, b3791, b4346, and/or YFL019C—protein(s) or of a protein having the sequence of a polypeptide encoded by a nucleic acid molecule indicated in Table II, columns 5 or 7, lines 38 to 43, 386, 387, 391, 396, 399 to 401, 403, 406, 413, 414, 417, 418, 421, 424, 427, 434 and/or 435;

in a non-human organism in one or more parts thereof and (b) growing the organism under conditions which permit the production of the fine chemical, meaning of glutamate or fine chemicals comprising glutamate in said organism;

or (a) increasing or generating the activity of one or more YBR030W, YDL106C, YDR271c, YEL045C, YER173W, YFL050C, YGR135W, YIL150C, YNL090 W, YPR138C, b0730, b2699, b1827, b0138, b0149, b1360, b2553, b2664, b3644 and/or b3919—protein(s) or of a protein having the sequence of a polypeptide encoded by a nucleic acid molecule indicated in Table II, columns 5 or 7, lines 44 to 56, 388, 389, 398, 411, 412, 425 and/or 429;

in a non-human organism in one or more parts thereof and (b) growing the organism under conditions which permit the production of the fine chemical, meaning of proline or fine chemicals comprising proline in said organism;

or (a) increasing or generating the activity of one or more YER173W, YFR042W, YKR057W, b1829, b1852, b4265, b0161, b0486, b0849, b0970, b1343, b1886, b1926, b2414, b2426, b2489, b2553, b2818, b3064, b3160, b3166, b3169, b3231, b3680, b3719, b4004, b4074 and/or b4133-protein(s) or of a protein having the sequence of a polypeptide encoded by a nucleic acid molecule indicated in Table II, columns 5 or 7, lines 57 to 62, 392 to 395, 397, 402, 404, 407 to 410, 415, 416, 419, 420, 422, 423, 426, 428 and/or 431 to 433;

in a non-human organism in one or more parts thereof and (b) growing the organism under conditions which permit the production of the fine chemical, meaning glutamine or fine chemicals comprising glutamine in said organism.

Accordingly, the present invention relates to a process for the production of a fine chemical comprising (a) increasing or generating the activity of one or more proteins having the activity of a protein indicated in Table II, column 3, lines 30 to 62 and/or lines 386 to 435 or having the sequence of a polypeptide encoded by a nucleic acid molecule indicated in Table I, column 5 or 7, lines 30 to 62 and/or lines 386 to 435, in a non-human organism in one or more parts thereof and (b) growing the organism under conditions which permit the production of the fine chemical, in particular arginine and/or glutamate and/or glutamine and/or proline resp.

Accordingly, the term "the fine chemical" means in one embodiment "arginine" in relation to all sequences listed in Table I to IV, lines 30 to 37, 390, 405 and/or 430 or homologs thereof and means in one embodiment "glutamate" in relation to all sequences listed in Tables I to IV, lines 38 to 43, 386, 387, 391, 396, 399 to 401, 403, 406, 413, 414, 417, 418, 421, 424, 427, 434 and/or 435 or homologs thereof and means in one embodiment "proline" in relation to all sequences listed in Table I to IV, lines 44 to 56, 388, 389, 398, 411, 412, 425 and/or 429 or homologs thereof and means in one embodiment "glutamine" in relation to all sequences listed in Tables I to IV, lines 57 to 62, 392 to 395, 397, 402, 404, 407 to 410, 415, 416, 419, 420, 422, 423, 426, 428 and/or 431 to 433 or homologs thereof.

Accordingly, in one embodiment the term "the fine chemical" means "glutamate" and "proline" in relation to all sequences listed in Table I to IV, lines 43 and 54, in one embodiment the term "the fine chemical" means "arginine" and "glutamine" in relation to all sequences listed in Table I to IV, lines 32 and 59, and, lines 34 and 60, and, 390 and 392, in one embodiment the term "the fine chemical" means "glutamine" and "proline" in relation to all sequences listed in Table I to IV, lines 57 and 48, and, 410 and 411, in one embodiment the term "the fine chemical" means "arginine" and "glutamate" in relation to all sequences listed in Table I to IV, lines 390 and 391, and, 405 and 406.

in one embodiment the term "the fine chemical" means "glutamate" and "glutamine" in relation to all sequences listed in Table I to IV, lines 391 and 392, and, 396 and 397, and, 414 and 415, and, 421 and 422, and, 427 and 428, in one embodiment the term "the fine chemical" means "arginine" and "glutamate" and "glutamine" in relation to all sequences listed in Table I to IV, lines 390 and 391 and 392.

Accordingly, the term "the fine chemical" can mean "arginine" and/or "glutamate" and/or "glutamine" and/or "proline", owing to circumstances and the context. In order to illustrate that the meaning of the term "the fine chemical" means "arginine", and/or "glutamate" and/or "glutamine" and/or "proline" the term "the respective fine chemical" is also used.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

The term "Table I" used in this specification is to be taken to specify the content of Table I A and Table I B. The term "Table II" used in this specification is to be taken to specify the content of Table II A and Table II B. The term "Table I A" used in this specification is to be taken to specify the content of Table I A. The term "Table I B" used in this specification is to be taken to specify the content of Table I B. The term "Table II A" used in this specification is to be taken to specify the content of Table II A. The term "Table II B" used in this specification is to be taken to specify the content of Table II B. In one preferred embodiment, the term "Table I" means Table I B. In one preferred embodiment, the term "Table II" means Table II B.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the respective fine chemical in comparison to the reference as defined below, e.g. that means in comparison to an organism without the aforementioned modification of the activity of a protein indicated in Table II, column 3, lines 30 to 62 and/or lines 386 to 435 or encoded by nucleic acid molecule indicated in Table I, columns 5 or 7, lines 30 to 62 and/or lines 386 to 435.

Surprisingly it was found, that the transgenic expression of at least one of the *Saccaromyces* cerevisiae protein(s) indicated in Table II, Column 3, lines 30 to 33 for arginine
and/or lines 38 to 42 and/or 435 for glutamate
and/or lines 44 to 53 for proline
and/or lines 57 to 59 for glutamine
in *Arabidopsis thaliana* conferred an increase in the respective fine chemical content of the transformed plants
and/or
at least one of the *Escherichia coli* K12 proteins indicated in Table II, Column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine
in *Arabidopsis thaliana* conferred an increase in the respective fine chemical content of the transformed plants.

Accordingly, it was surprisingly found, that the transgenic expression of the *Escherichia coli* K12 protein as indicated in Table II, column 5, lines 43 and 54 in *Arabidopsis thaliana* conferred an increase in glutamate and/or proline (or the respective fine chemical) content of the transformed plants. Thus, in one embodiment, said protein or its homologs are used for the production of glutamate; in one embodiment, said protein or its homologs are used for the production of proline; in one embodiment, said protein or its homologs are used for the production of one or more fine chemical selected from the group consisting of: glutamate and/or proline.

Accordingly, it was surprisingly found, that the transgenic expression of the *Escherichia coli* K12 protein as indicated in Table II, column 5, lines 43 and 54 and/or lines 390 and 392 and/or the *Saccharomyces cerevisiae* protein as indicated in Table II, column 5, lines 32 and 59 in *Arabidopsis thaliana* conferred an increase in arginine and/or glutamine (or the respective fine chemical) content of the transformed plants. Thus, in one embodiment, said protein or its homologs are used for the production of arginine; in one embodiment, said protein or its homologs are used for the production of glutamine; in one embodiment, said protein or its homologs are used for the production of one or more fine chemical selected from the group consisting of: arginine and/or glutamine.

Surprisingly it was found, that the transgenic expression of the *Saccharomyces cerevisiae* protein as indicated in Table II, column 5, lines 48 and 57 and/or the *Escherichia coli* K12 protein as indicated in Table II, column 5, lines 411 and 410 in *Arabidopsis thaliana* conferred an increase in proline and/or glutamine (or the respective fine chemical) content of the transformed plants. Thus, in one embodiment, said protein or its homologs are used for the production of proline; in one embodiment, said protein or its homologs are used for the production of glutamine, in one embodiment, said protein or its homologs are used for the production of one or more fine chemical selected from the group consisting of: proline and/or glutamine.

Surprisingly it was found, that the transgenic expression of the *Escherichia coli* K12 protein as indicated in Table II, column 5, lines 391 and 392 and/or lines 396 and 397 and/or lines 414 and 415 and/or lines 421 and 422 and/or lines 427 and 428 in *Arabidopsis thaliana* conferred an increase in glutamate and/or glutamine (or the respective fine chemical) content of the transformed plants. Thus, in one embodiment, said protein or its homologs are used for the production of glutamate; in one embodiment, said protein or its homologs are used for the production of glutamine, in one embodiment, said protein or its homologs are used for the production of one or more fine chemical selected from the group consisting of: glutamate and/or glutamine.

Surprisingly it was found, that the transgenic expression of the *Escherichia coli* K12 protein as indicated in Table II, column 5, lines 390 and 391, and, 405 and 406 in *Arabidopsis thaliana* conferred an increase in arginine and/or glutamate (or the respective fine chemical) content of the transformed plants. Thus, in one embodiment, said protein or its homologs are used for the production of arginine, in one embodiment, said protein or its homologs are used for the production of glutamate, in one embodiment, said protein or its homologs are used for the production of arginine and glutamate.

Surprisingly it was found, that the transgenic expression of the *Escherichia coli* K12 protein as indicated in Table II, column 5, lines 390 and 391 and 392 in *Arabidopsis thaliana* conferred an increase in arginine and/or glutamate and/or glutamine (or the respective fine chemical) content of the transformed plants. Thus, in one embodiment, said protein or its homologs are used for the production of arginine, in one embodiment, said protein or its homologs are used for the production of glutamate; in one embodiment, said protein or its homologs are used for the production of glutamine, in one embodiment, said protein or its homologs are used for the production of one or more fine chemical selected from the group consisting of: arginine and/or glutamate and/or glutamine.

In accordance with the invention, the term "organism" as understood herein relates always to a non-human organism, in particular to an animal or plant organism or to a microorganism. Further, the term "animal" as understood herein relates always to a non-human animal.

In accordance with the invention it is known to the skilled that anionic compounds such as acids are present in aqueous solutions in an equilibrium between the acid and its salts according to the pH present in the respective compartment of the cell or organism and the pK of the acid. Depending on the strength of the acid (pK) and the pH the salt or the free acid are predominant. Thus, the term "the fine chemical", the term "the respective fine chemical", or the term "acid" or the use of a denomination referring to a neutralized anionic compound relates to the anionic form as well as the neutralised status of that compound according to the milieu of the aqueous solution in which they are present.

The sequence of b0695 from *Escherichia coli* K12 has been published in Blattner et al., Science 277(5331), 1453-1474, 1997, and its activity is being defined as sensory histidine kinase in two-component regulatory system. Accordingly, in one embodiment, the process of the present invention comprises the use of a gene product with an activity of the sensor histidine kinase homology superfamily, preferably a protein with a sensory histidine kinase in two-component regulatory system activity from *E. coli* or its homolog, e.g. as shown herein, for the production of the fine chemical, meaning of arginine, in particular for increasing the amount of arginine, preferably arginine in free or bound form in an organism or a part thereof, as mentioned.

The sequence of b0730 from *Escherichia coli* K12 has been published in Blattner et al., Science 277(5331), 1453-1474, 1997, and its activity is being defined as transcriptional regulator of succinylCoA synthetase operon and fatty acyl response regulator. Accordingly, in one embodiment, the process of the present invention comprises the use of a gene product with an activity of the transcription regulator GntR superfamily, preferably a protein with a transcriptional regulator of succinylCoA synthetase operon or a fatty acid response regulator activity from *E. coli* or its homolog, e.g. as shown herein, for the production of the fine chemical, meaning of glutamate and/or proline, in particular for increasing the amount of glutamate and/or proline, in particular for increasing the amount of glutamate, in particular for increasing the amount of proline, in particular for increasing the amount of glutamate and proline, preferably glutamate and/or proline in free or bound form in an organism or a part thereof, as mentioned.

The sequence of b1284 from *Escherichia coli* K12 has been published in Blattner et al., Science 277(5331), 1453-1474, 1997, and its activity is being defined as a putative transcriptional regulator with DNA-binding Winged helix domain (DeoR family). Accordingly, in one embodiment, the process of the present invention comprises the use of a gene product with an activity of the regulatory protein gutR superfamily, preferably a protein with transcriptional regulator with DNA-binding Winged helix domain (DeoR family) activity from *E. coli* or its homolog, e.g. as shown herein, for the production of the fine chemical, meaning of arginine, in particular for increasing the amount of arginine, preferably arginine in free or bound form in an organism or a part thereof, as mentioned.

The sequence of b1827 from *Escherichia coli* K12 has been published in Blattner et al., Science 277(5331), 1453-1474, 1997, and its activity is being defined as a putative transcriptional repressor protein with a DNA-binding Winged helix domain (IclR family). Accordingly, in one embodiment, the process of the present invention comprises the use of a gene product with an activity of the acetate operon repressor superfamily, preferably a protein with a transcriptional repressor protein with a DNA-binding Winged helix domain (IclR family) activity from *E. coli* or its homolog, e.g. as shown herein, for the production of the fine chemical, meaning of arginine, in particular for increasing the amount of arginine, preferably arginine in free or bound form in an organism or a part thereof, as mentioned.

The sequence of b1829 from *Escherichia coli* K12 has been published in Blattner et al., Science 277(5331), 1453-1474, 1997, and its activity is being defined as a heat shock protein with protease activity. Accordingly, in one embodiment, the process of the present invention comprises the use of a gene product with an activity of heat-shock protein htpX superfamily, preferably a protein with a "heat shock protein with protease activity" from *E. coli* or its homolog, e.g. as shown herein, for the production of the fine chemical, meaning of glutamine and/or proline, in particular for increasing the amount of arginine and/or glutamine, in particular for increasing the amount of proline, in particular for increasing the amount of glutamine, in particular for increasing the amount of proline and glutamine, preferably increasing the amount of proline and/or glutamine, in free or bound form in an organism or a part thereof, as mentioned. In one embodiment, in the process of the present invention the activity of a heat shock protein with protease activity is increased or generated, e.g. from *E. coli* or a homolog thereof.

The sequence of b1852 from *Escherichia coli* K12 has been published in Blattner et al., Science 277(5331), 1453-1474, 1997, and its activity is being defined as a glucose-6-phosphate dehydrogenase. Accordingly, in one embodiment, the process of the present invention comprises the use of a gene product with an activity of glucose-6-phosphate dehydrogenase superfamily, preferably a protein with a glucose-6-phosphate dehydrogenase activity from *E. coli* or its homolog, e.g. as shown herein, for the production of the fine chemical, meaning of glutamine, in particular for increasing the amount of glutamine, preferably increasing the amount of glutamine in free or bound form in an organism or a part thereof, as mentioned.

The sequence of b2095 from *Escherichia coli* K12 has been published in Blattner et al., Science 277(5331), 1453-1474, 1997, and its activity is being defined as a tagatose-6-phosphate kinase. Accordingly, in one embodiment, the process of the present invention comprises the use of a gene product with an activity of *Escherichia* probable tagatose 6-phosphate kinase gatZ superfamily, preferably a protein with a tagatose-6-phosphate kinase activity from *E. coli* or its homolog, e.g. as shown herein, for the production of the fine chemical, meaning of arginine, in particular for increasing the amount of arginine, preferably increasing the amount of arginine in free or bound form in an organism or a part thereof, as mentioned.

The sequence of b2699 from *Escherichia coli* K12 has been published in Blattner et al., Science 277(5331), 1453-1474, 1997, and its activity is being defined as a DNA strand exchange and recombination protein with protease and nuclease activity. Accordingly, in one embodiment, the process of the present invention comprises the use of a gene product with an activity of recombination protein recA superfamily, preferably a protein with a DNA strand exchange and recombination protein with protease and nuclease activity from *E. coli* or its homolog, e.g. as shown herein, for the production of the fine chemical, meaning of proline, in particular for increasing the amount of proline, preferably increasing the amount of proline in free or bound form in an organism or a part thereof, as mentioned.

The sequence of b4265 from *Escherichia coli* K12 has been published in Blattner et al., Science 277(5331), 1453-1474, 1997, and its activity is being defined as a L-idonate transport protein. Accordingly, in one embodiment, the process of the present invention comprises the use of a gene product with an activity of D-serine permease superfamily, preferably a protein with a L-idonate transport protein activity from *E. coli* or its homolog, e.g. as shown herein, for the production of the fine chemical, meaning of glutamine, in particular for increasing the amount of glutamine, preferably increasing the amount of glutamine in free or bound form in an organism or a part thereof, as mentioned.

The sequence of YBR030W from *Saccharomyces cerevisiae* has been published in Feldmann et al., EMBO J., 13 (24), 5795-5809 (1994) and Goffeau, Science 274 (5287), 546-547, 1996, and its cellular activity has not been characterized yet. Accordingly, in one embodiment, the process of the present invention comprises the use of a gene product with an activity of *Saccharomyces cerevisiae* hypothetical protein YBR030w superfamily, preferably a protein with a YBR030W activity from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned.

The sequence of YDL106C from *Saccharomyces cerevisiae* has been published in Jacq et al., Nature 387 (6632 Suppl), 75-78, 1997, and Goffeau, Science 274 (5287), 546-547, 1996, and its activity is being defined as homeobox transcription factor. Accordingly, in one embodiment, the process of the present invention comprises the use of a gene product with an activity of unassigned homeobox proteins, homeobox homology proteins superfamily, preferably a protein with a "homeobox transcription factor" activity or its homolog, e.g. as shown herein, for the production of the fine chemical, meaning of proline, in particular for increasing the amount of proline, preferably proline in free or bound form in an organism or a part thereof, as mentioned.

The sequence of YFR0 42W from *Saccharomyces cerevisiae* has been published in Goffeau et al., Science 274 (5287), 546-547, 1996 and Murakami, Y., Nat. Genet. 10 (3), 261-268, 1995 and its activity is being defined as a "protein required for cell viability in yeast". Accordingly, in one embodiment, the process of the present invention comprises the use of a gene product with an activity of *Saccharomyces cerevisiae* probable membrane protein YFR0 42w superfamily, preferably a protein with a "protein required for cell viability in yeast" activity, from *Saccharomyces cerevisiae* or its homolog, e.g. as shown herein, for the production of the fine chemical, meaning of glutamine, in particular for increasing the amount of glutamine, preferably glutamine in free or bound form in an organism or a part thereof, as mentioned.

The sequence of YGR135W from *Saccharomyces cerevisiae* has been published in Goffeau et al., Science 274 (5287), 546-547, 1996 and Tettelin et al., Nature 387 (6632 Suppl), 81-84 (1997) and its activity is being defined as a "proteasome component Y13". Accordingly, in one embodiment, the process of the present invention comprises the use of a a gene product with an activity of multicatalytic endopeptidase complex chain C9 superfamily, preferably a protein with proteasome component Y13 activity, from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned.

The sequence of YHR130C from *Saccharomyces cerevisiae* has been published in Johnston et al., Science 265:2077-2082 (1994), and its cellular activity has not been characterized yet. Accordingly, in one embodiment, the process of the present invention comprises the use of a YHR130C activity from *Saccharomyces cerevisiae* or its homolog, e.g. as shown herein, for the production of the fine chemical, meaning of arginine, in particular for increasing the amount of arginine, preferably arginine in free or bound form in an organism or a part thereof, as mentioned.

The sequence of YIL150C from *Saccharomyces cerevisiae* has been published in Goffeau et al., Science 274 (5287), 546-547, 1996 and Churcher et al., Nature 387 (6632 Suppl), 84-87, 1997 and its activity is being defined as a chromatin binding protein, required for S-phase (DNA synthesis) initiation or completion. Accordingly, in one embodiment, the process of the present invention comprises the use of a chromatin binding protein, required for S-phase (DNA synthesis) initiation or completion, from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned.

The sequence of YPR024W from *Saccharomyces cerevisiae* has been published in Goffeau et al., Science 274 (5287), 546-547, 1996 and Bussey et al., Nature 387 (6632 Suppl), 103-105 (1997) and its activity is being defined as a mitochondrial protein of the CDC48/PAS1/SEC18 family of ATPases. Accordingly, in one embodiment, the process of the present invention comprises the use of a gene product with an activity of FtsH/SEC18/CDC48-type ATP-binding domain homology; cell division protein ftsH superfamily, preferably a protein with a mitochondrial protein of the CDC48/PAS1/SEC18 family of ATPases activity, from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

The sequence of YPR133W-A from *Saccharomyces cerevisiae* has been published in Goffeau et al., Science 274 (5287), 546-547, 1996 and Bussey et al., Nature 387 (6632 Suppl), 103-105 (1997) and its activity is being defined as a translocase of the outer mitochondrial membrane. Accordingly, in one embodiment, the process of the present invention comprises the use of a translocase of the outer mitochondrial membrane, from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

The sequence of YPR138C from *Saccharomyces cerevisiae* has been published in Goffeau et al., Science 274 (5287), 546-547, 1996 and Bussey et al., Nature 387 (6632 Suppl), 103-105 (1997) and its activity is being defined as a $NH^{4+}$ transporter. Accordingly, in one embodiment, the process of the present invention comprises the use of a gene product with an activity of ammonium transport protein; ammonium transporter nrgA superfamily, preferably a protein with a $NH^{4+}$ transporter activity, from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned.

The sequence of YBR204C from *Saccharomyces cerevisiae* has been published in Goffeau et al., Science 274 (5287), 546-547, 1996 and Feldmann et al., EMBO J. 13 (24), 5795-5809 (1994) and its activity is being defined as a peroxisomal lipase. Accordingly, in one embodiment, the process of the present invention comprises the use of a peroxisomal lipase, from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

The sequence of YDR271C was submitted by Le T., Johnston M., (March-1996) to the EMBL/GenBank/DDBJ databases, by Waterston R.; (MAY—1996) and Jia Y., (JUNE—1997) to the EMBL/GenBank/DDBJ databases and its cellular activity has not been characterized yet. Accordingly, in one embodiment, the process of the present invention comprises the use of a YDR271C activity from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned. I The sequence of YDR316W from *Saccharomyces cerevisiae* has been published in Goffeau et al., Science 274 (5287), 546-547, 1996 and Jacq et al., Nature 387 (6632 Suppl), 75-78 (1997), and its activity is being defined as a putative S-adenosylmethionine-dependent methyltransferase of the seven beta-strand family. Accordingly, in one embodiment, the process of the present invention comprises the use of a a gene product with an activity of bioC homology superfamily, preferably a protein with putative S-adenosylmethionine-dependent methyltransferase of the seven beta-strand family activity, from *Saccharomyces cerevisiae* or its homolog, e.g. as shown herein, for the production of the fine chemical, meaning of arginine in particular for increasing the amount of arginine, preferably arginine in free or bound form in an organism or a part thereof, as mentioned.

The sequence of YEL045C from *Saccharomyces cerevisiae* was published by Dietrich et al., Nature 387:78-81 (1997) and its cellular activity has not been characterized yet. Accordingly, in one embodiment, the process of the present invention comprises the use of a gene product with an activity of *Saccharomyces* hypothetical protein YEL045c superfamily, preferably a protein with a YEL045C activity from *Saccharomyces cerevisiae* or its homolog, e.g. as shown herein, for the production of the fine chemical, meaning of proline, in particular for increasing the amount of proline, preferably proline in free or bound form in an organism or a part thereof, as mentioned.

The sequence of YER173w from *Saccharomyces cerevisiae* has been published in Dietrich, Nature 387 (6632 Suppl), 78-81, 1997, and Goffeau, Science 274 (5287), 546-547, 1996, and its activity is being defined as an "Checkpoint protein, involved in the activation of the DNA damage and meiotic pachytene checkpoints;". Accordingly, in one embodiment, the process of the present invention comprises the use of a "Checkpoint protein, involved in the activation of the DNA damage and meiotic pachytene checkpoints" or its homolog, e.g. as shown herein, for the production of the fine chemical, meaning the amount of glutamine and/or proline, in particular for increasing the amount of glutamine and/or proline, in particular for increasing the amount of glutamine, in particular for increasing the amount of proline, in particular for increasing the amount of glutamine and proline, preferably glutamine and/or proline in free or bound form in an organism or a part thereof, as mentioned.

The sequence of YFL013C from *Saccharomyces cerevisiae* has been published in Goffeau, A., Science 274 (5287), 546-547, 1996 and Murakami, Y., Nat. Genet. 10 (3), 261-268, 1995, and its activity is being defined as a "subunit of the INO80 chromatin remodeling complex". Accordingly, in one embodiment, the process of the present invention comprises the use of a gene product with an activity of *Saccharomyces cerevisiae* probable membrane protein YFL013c superfamily, preferably a protein with a "subunit of the INO80 chromatin remodeling complex" activity or its homolog, for the production of the fine chemical, meaning of glutamate, in particular for increasing the amount of glutamate, preferably glutamate in free or bound form in an organism or a part thereof, as mentioned.

The sequence of YFL050C from *Saccharomyces cerevisiae* has been published in Murakami et al., Nat. Genet. 10 (3), 261-268, 1995, and Goffeau et al., Science 274 (5287), 546-547, 1996, and its activity is defined as a di-trivalent inorganic cation transporter. Accordingly, in one embodiment, the process of the present invention comprises the use of a a gene product with an activity of magnesium and cobalt transport protein superfamily, preferably a protein with a di-trivalent inorganic cation transporter activity from *Saccaromyces* cerevisiae or its homolog, e.g. as shown herein, for the production of the fine chemical, meaning proline, in particular for increasing the amount of proline, preferably proline in free or bound form in an organism or a part thereof, as mentioned.

The sequence of YGR104C from *Saccharomyces cerevisiae* has been published in Thompson et al., Cell 73:1361-1375, 1993, and its activity is being defined as an "RNA polymerase II suppressor protein SRB5—yeast and/or suppressor of RNA polymerase B SRB5". Accordingly, in one embodiment, the process of the present invention comprises the use of a gene product with an activity of RNA polymerase II suppressor protein SRB5—yeast superfamily, preferably a protein with a "RNA polymerase II suppressor protein SRB5—yeast and/or suppressor of RNA polymerase B SRB5" activity or its homolog, for the production of the fine chemical, meaning of glutamate, in particular for increasing the amount of glutamate, preferably glutamate in free or bound form in an organism or a part thereof, as mentioned.

The sequence of YKR057W from *Saccharomyces cerevisiae* has been published in Dujon et al., Nature 369 (6479), 371-378, 1994 and Goffeau et al., Science 274 (5287), 546-547, 1996 and its activity is being defined as a ribosomal protein, similar to S21 ribosomal proteins, involved in ribosome biogenesis and translation. Accordingly, in one embodiment, the process of the present invention comprises the use of a gene product with an activity of rat ribosomal protein S21 superfamily, preferably a protein with a ribosomal protein, similar to S21 ribosomal proteins, involved in ribosome biogenesis and translation activity from *Saccharomyces cerevisiae* or its homolog, e.g. as shown herein, for the production of the fine chemical, meaning of arginine and/or glutamine, in particular for increasing the amount of arginine and/or glutamine, in particular for increasing the amount of arginine, in particular for increasing the amount of glutamine, in particular for increasing the amount of arginine and glutamine, preferably arginine and/or glutamine in free or bound form in an organism or a part thereof, as mentioned.

The sequence of b0050 (Accession number NP_414592) from *Escherichia coli* K12 has been published in Blattner et al., Science 277 (5331), 1453-1474, 1997, and its activity is being defined as a conserved protein potentially involved in protein interaction. Accordingly, in one embodiment, the process of the present invention comprises the use of a gene product with an activity of apaG protein superfamily, preferably a protein with the activity of a conserved protein potentially involved in protein-protein interaction from *E. coli* or its homolog, e.g. as shown herein, for the production of the fine chemical, meaning of glutamate in particular for increasing the amount of glutamate, preferably glutamate in free or bound form in an organism or a part thereof, as mentioned.

The sequence of b0057 (Accession number NP_414599) from *Escherichia coli* K12 has been published in Blattner et al., Science 277 (5331), 1453-1474, 1997, and its activity is not been characterized yet. Accordingly, in one embodiment, the process of the present invention comprises the use of a gene product with an activity of b0057 protein from *E. coli* or its homolog, e.g. as shown herein, for the production of the fine chemical, meaning of glutamate in particular for increasing the amount of glutamate, preferably glutamate in free or bound form in an organism or a part thereof, as mentioned.

The sequence of b0138 (Accession number NP_414680) from *Escherichia coli* K12 has been published in Blattner et al., Science 277 (5331), 1453-1474, 1997, and its activity is being defined as a fimbrial-like adhesin protein. Accordingly, in one embodiment, the process of the present invention comprises the use of a gene product with an activity of b0138 protein from *E. coli* or its homolog, e.g. as shown herein, for the production of the fine chemical, meaning of proline in particular for increasing the amount of proline, preferably proline in free or bound form in an organism or a part thereof, as mentioned.

The sequence of b0149 (Accession number NP_414691) from *Escherichia coli* K12 has been published in Blattner et al., Science 277 (5331), 1453-1474, 1997, and its activity is being defined as a bifunctional penicillin-binding protein 1b: glycosyl transferase (N-terminal); transpeptidase (C-terminal). Accordingly, in one embodiment, the process of the present invention comprises the use of a gene product with an activity of penicillin-binding protein 1B superfamily, preferably a protein with the activity of a bifunctional penicillin-binding protein 1b: glycosyl transferase (N-terminal); transpeptidase (C-terminal) from *E. coli* or its homolog, e.g. as shown herein, for the production of the fine chemical, meaning of proline, in particular for increasing the amount of proline, preferably proline in free or bound form in an organism or a part thereof, as mentioned.

The sequence of b0161 (Accession number NP_414691) from *Escherichia coli* K12 has been published in Blattner et al., Science 277 (5331), 1453-1474, 1997, and its activity is being defined as a periplasmic serine protease (heat shock protein). Accordingly, in one embodiment, the process of the present invention comprises the use of a gene product with an activity of *Helicobacter* serine proteinase superfamily, preferably a protein with the activity of a periplasmic serine protease (heat shock protein) from *E. coli* or its homolog, e.g. as shown herein, for the production of the fine chemical, meaning of arginine and/or glutamate and/or glutamine, in particular for increasing the amount of arginine, in particular for increasing the amount of glutamate, in particular for increasing the amount of glutamine, in particular for increasing the amount of arginine and glutamate, in particular for increasing the amount of arginine and glutamine, in particular for increasing the amount of glutamine and glutamate, in particular for increasing the amount of arginine and glutamine and glutamate, preferably arginine and/or glutamate and/or glutamine in free or bound form in an organism or a part thereof, as mentioned.

The sequence of b0486 (Accession number NP_415019) from *Escherichia coli* K12 has been published in Blattner et al., Science 277 (5331), 1453-1474, 1997, and its activity is being defined as a amino-acid/amine transport protein (APC family). Accordingly, in one embodiment, the process of the present invention comprises the use of a gene product with an activity of membrane protein ybaT superfamily, preferably a protein with the activity of a amino-acid/amine transport protein (APC family) from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b0849 (Accession number NP_415370) from *Escherichia coli* K12 has been published in Blattner et al., Science 277 (5331), 1453-1474, 1997, and its activity is being defined as a glutaredoxin 1 redox coenzyme for glutathione-dependent ribonucleotide reductase. Accordingly, in one embodiment, the process of the present invention comprises the use of a gene product with an activity of glutaredoxin superfamily, preferably a protein with the activity of a glutaredoxin 1 redox coenzyme for glutathione-dependent ribonucleotide reductase protein from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b0970 (Accession number NP_415490) from *Escherichia coli* K12 has been published in Blattner et al., Science 277 (5331), 1453-1474, 1997, and its activity is being defined as a glutamate receptor. Accordingly, in one embodiment, the process of the present invention comprises the use of a gene product with an activity of *Escherichia coli* ybhL protein superfamily, preferably a protein with the activity of a glutamate receptor protein from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b1343 (Accession number NP_415490) from *Escherichia coli* K12 has been published in Blattner et al., Science 277 (5331), 1453-1474, 1997, and its activity is being defined as a ATP-dependent RNA helicase, stimulated by 23S rRNA. Accordingly, in one embodiment, the process of the present invention comprises the use of a gene product with an activity of *Escherichia coli* b1343 protein, preferably a protein with the activity of a ATP-dependent RNA helicase, stimulated by 23S rRNA from *E. coli* or its homolog, e.g. as shown herein, for the production of the fine chemical, meaning of glutamine and/or glutamate, in particular for increasing the amount of glutamine, in particular for increasing the amount of glutamate, in particular for increasing the amount of glutamine and glutamate, preferably glutamine and/or glutamate in free or bound form in an organism or a part thereof, as mentioned.

The sequence of b1360 (Accession number NP_415878) from *Escherichia coli* K12 has been published in Blattner et al., Science 277 (5331), 1453-1474, 1997, and its activity is being defined as a DNA replication protein. Accordingly, in one embodiment, the process of the present invention comprises the use of a gene product with an activity of DNA replication protein dnaC superfamily, preferably a protein with the activity of a DNA replication protein from *E. coli* or its homolog, e.g. as shown herein, for the production of the fine chemical, meaning of proline, in particular for increasing the amount of proline, preferably proline in free or bound form in an organism or a part thereof, as mentioned.

The sequence of b1693 (Accession number NP_416208) from *Escherichia coli* K12 has been published in Blattner et al., Science 277 (5331), 1453-1474, 1997, and its activity is being defined as a 3-dehydroquinate dehydratase. Accordingly, in one embodiment, the process of the present invention comprises the use of a gene product with an activity of 3-dehydroquinate dehydratase superfamily, preferably a protein with the activity of a DNA replication protein from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of b1736 (Accession number NP_416250) from *Escherichia coli* K12 has been published in Blattner et al., Science 277 (5331), 1453-1474, 1997, and its activity is being defined as a PEP-dependent phosphotransferase enzyme, cellobiose/arbutin/salicin sugar-specific protein. Accordingly, in one embodiment, the process of the present invention comprises the use of a gene product with an activity of phosphotransferase system lactose-specific enzyme II, factor III superfamily, preferably a protein with the activity of a PEP-dependent phosphotransferase enzyme, cellobiose/arbutin/salicin sugar-specific protein from E. coli or its homolog, e.g. as shown herein, for the production of the fine chemical, meaning of glutamate, in particular for increasing the amount of glutamate, preferably glutamate in free or bound form in an organism or a part thereof, as mentioned.

The sequence of b1738 (Accession number NP_416252) from Escherichia coli K12 has been published in Blattner et al., Science 277 (5331), 1453-1474, 1997, and its activity is being defined as a PEP-dependent phosphotransferase. Accordingly, in one embodiment, the process of the present invention comprises the use of a gene product with an activity of phosphotransferase system enzyme II cellobiose-specific factor IIB superfamily, preferably a protein with the activity of a PEP-dependent phosphotransferase from E. coli or its homolog, e.g. as shown herein, for the production of the fine chemical, meaning of glutamate, in particular for increasing the amount of glutamate, preferably glutamate in free or bound form in an organism or a part thereof, as mentioned The sequence of b1886 (Accession number NP_416400) from Escherichia coli K12 has been published in Blattner et al., Science 277 (5331), 1453-1474, 1997, and its activity is being defined as a methyl-accepting chemotaxis protein II, aspartate sensor receptor. Accordingly, in one embodiment, the process of the present invention comprises the use of a gene product with an activity of methyl-accepting chemotaxis protein superfamily, preferably a protein with the activity of a methyl-accepting chemotaxis protein II, aspartate sensor receptor from E. coli or its homolog, e.g. as shown herein, for the production of the fine chemical, meaning of glutamine, in particular for increasing the amount of glutamine, preferably glutamine in free or bound form in an organism or a part thereof, as mentioned.

The sequence of b1896 (Accession number NP_416410) from Escherichia coli K12 has been published in Blattner et al., Science 277 (5331), 1453-1474, 1997, and its activity is being defined as a trehalose-6-phosphate synthase. Accordingly, in one embodiment, the process of the present invention comprises the use of a gene product with an activity of alpha-trehalose-phosphate synthase (UdP-forming) superfamily, preferably a protein with the activity of a trehalose-6-phosphate synthase from E. coli or its homolog, e.g. as shown herein, for the production of the fine chemical, meaning of glutamate, in particular for increasing the amount of glutamate, preferably glutamate in free or bound form in an organism or a part thereof, as mentioned The sequence of b1926 (Accession number NP_416436) from Escherichia coli K12 has been published in Blattner et al., Science 277 (5331), 1453-1474, 1997, and its activity is being defined as a flagellar protein fliT. Accordingly, in one embodiment, the process of the present invention comprises the use of a gene product with an activity of flagellar protein fliT from E. coli or its homolog, e.g. as shown herein, for the production of the fine chemical, meaning of glutamine, in particular for increasing the amount of glutamine, preferably glutamine in free or bound form in an organism or a part thereof, as mentioned.

The sequence of b2307 (Accession number NP_416810) from Escherichia coli K12 has been published in Blattner et al., Science 277 (5331), 1453-1474, 1997, and its activity is being defined as a histidine and lysine/arginine/ornithine transport protein (ABC superfamily, membrane). Accordingly, in one embodiment, the process of the present invention comprises the use of a gene product with an activity of histidine permease protein M superfamily, preferably a protein with the activity of a histidine and lysine/arginine/ornithine transport protein (ABC superfamily, membrane) from E. coli or its homolog, e.g. as shown herein, for the production of the fine chemical, meaning of glutamate and/or arginine, in particular for increasing the amount of glutamate, in particular for increasing the amount of arginine, in particular for increasing the amount of glutamate and arginine, preferably glutamate and/or arginine in free or bound form in an organism or a part thereof, as mentioned.

The sequence of b2414 (Accession number NP_416909) from Escherichia coli K12 has been published in Blattner et al., Science 277 (5331), 1453-1474, 1997, and its activity is being defined as a subunit of cysteine synthase A and O-acetylserine sulfhydrolase A, PLP-dependent enzyme. Accordingly, in one embodiment, the process of the present invention comprises the use of a gene product with an activity of threonine dehydratase superfamily, preferably a protein with the activity of a subunit of cysteine synthase A and O-acetylserine sulfhydrolase A, PLP-dependent enzyme from E. coli or its homolog, e.g. as shown herein, for the production of the fine chemical, meaning of glutamine, in particular for increasing the amount of glutamine, preferably glutamine in free or bound form in an organism or a part thereof, as mentioned.

The sequence of b2426 (Accession number NP_416921) from Escherichia coli K12 has been published in Blattner et al., Science 277 (5331), 1453-1474, 1997, and its activity is being defined as a putative oxidoreductase with NAD(P)-binding domain. Accordingly, in one embodiment, the process of the present invention comprises the use of a gene product with an activity of ribitol dehydrogenase, short-chain alcohol dehydrogenase homology superfamily, preferably a protein with the activity of a putative oxidoreductase with NAD(P)-binding domain from E. coli or its homolog, e.g. as shown herein, for the production of the fine chemical, meaning of glutamine, in particular for increasing the amount of glutamine, preferably glutamine in free or bound form in an organism or a part thereof, as mentioned.

The sequence of b2489 (Accession number NP_416984) from Escherichia coli K12 has been published in Blattner et al., Science 277 (5331), 1453-1474, 1997, and its activity is being defined as a hydrogenase Fe—S subunit. Accordingly, in one embodiment, the process of the present invention comprises the use of a gene product with an activity of psbG protein superfamily, preferably a protein with the activity of a hydrogenase Fe—S subunit from E. coli or its homolog, e.g. as shown herein, for the production of the fine chemical, meaning of glutamine, in particular for increasing the amount of glutamine, preferably glutamine in free or bound form in an organism or a part thereof, as mentioned.

The sequence of b2553 (Accession number NP_417048) from Escherichia coli K12 has been published in Blattner et al., Science 277 (5331), 1453-1474, 1997, and its activity is being defined as a regulatory protein P-II for glutamine synthetase. Accordingly, in one embodiment, the process of the present invention comprises the use of a gene product with an activity of regulatory protein P-II superfamily, preferably a protein with the activity of a regulatory protein P-II for glutamine synthetase from E. coli or its homolog, e.g. as shown herein, for the production of the fine chemical, meaning of proline and/or glutamine, in particular for increasing the amount of proline, in particular for increasing the amount of glutamine, in particular for increasing the amount of proline and glutamine, preferably proline and/or glutamine in free or bound form in an organism or a part thereof, as mentioned.

The sequence of b2664 (Accession number NP_417150) from *Escherichia coli* K12 has been published in Blattner et al., Science 277 (5331), 1453-1474, 1997, and its activity is being defined as a transcriptional repressor with DNA-binding Winged helix domain (GntR familiy). Accordingly, in one embodiment, the process of the present invention comprises the use of a gene product with an activity of transcription regulator gabP superfamily, preferably a protein with the activity of transcriptional repressor with DNA-binding Winged helix domain (GntR familiy) from *E. coli* or its homolog, e.g. as shown herein, for the production of the fine chemical, meaning of proline, in particular for increasing the amount of proline, preferably proline in free or bound form in an organism or a part thereof, as mentioned.

The sequence of b2710 (Accession number NP_417190) from *Escherichia coli* K12 has been published in Blattner et al., Science 277 (5331), 1453-1474, 1997, and its activity is being defined as a flavorubredoxin (FlRd) bifunctional NO and $O_2$ reductase. Accordingly, in one embodiment, the process of the present invention comprises the use of a gene product with an activity of *Escherichia coli* hypothetical protein b2710, rubredoxin homology, *Methanobacterium* flavoprotein A superfamily, preferably a protein with the activity of a flavorubredoxin (FlRd) bifunctional NO and $O_2$ reductase from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of b2818 (Accession number NP_417295) from *Escherichia coli* K12 has been published in Blattner et al., Science 277 (5331), 1453-1474, 1997, and its activity is being defined as a N-acetylglutamate synthase (amino acid N-acetyltransferase). Accordingly, in one embodiment, the process of the present invention comprises the use of a gene product with an activity of amino-acid acetyltransferase, acetylglutamate kinase superfamily, preferably a protein with the activity of a a N-acetylglutamate synthase (amino acid N-acetyltransferase) from *E. coli* or its homolog, e.g. as shown herein, for the production of the fine chemical, meaning of glutamine and/or glutamate, in particular for increasing the amount of glutamine, in particular for increasing the amount of glutamate, in particular for increasing the amount of glutamine and glutamte, preferably glutamate and/or glutamine in free or bound form in an organism or a part thereof, as mentioned.

The sequence of b3064 (Accession number NP_417536) from *Escherichia coli* K12 has been published in Blattner et al., Science 277 (5331), 1453-1474, 1997, and its activity is being defined as a O-sialoglycoprotein endopeptidase, with actin-like ATPase domain. Accordingly, in one embodiment, the process of the present invention comprises the use of a gene product with an activity of O-sialoglycoprotein endopeptidase superfamily, preferably a protein with the activity of a O-sialoglycoprotein endopeptidase, with actin-like ATPase domain from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b3074 (Accession number NP_417545) from *Escherichia coli* K12 has been published in Blattner et al., Science 277 (5331), 1453-1474, 1997, and its activity is being defined as a tRNA synthetase. Accordingly, in one embodiment, the process of the present invention comprises the use of a gene product with an activity of secretion chaperone CsaA, methionyl-tRNA synthetase, dimer-forming superfamily, preferably a protein with the activity of a tRNA synthetase from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of b3116 (Accession number NP_417586) from *Escherichia coli* K12 has been published in Blattner et al., Science 277 (5331), 1453-1474, 1997, and its activity is being defined as a L-threonine/L-serine permease, anaerobically inducible (HAAAP family). Accordingly, in one embodiment, the process of the present invention comprises the use of a gene product with an activity of threonine-serine permease superfamily, preferably a protein with the activity of a L-threonine/L-serine permease, anaerobically inducible (HAAAP family) from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of b3160 (Accession number NP_417629) from *Escherichia coli* K12 has been published in Blattner et al., Science 277 (5331), 1453-1474, 1997, and its activity is being defined as monooxygenase with luciferase-like ATPase activity. Accordingly, in one embodiment, the process of the present invention comprises the use of a gene product with an activity of ynbW protein superfamily, preferably a protein with the activity of a monooxygenase with luciferase-like ATPase activity from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b3166 (Accession number NP_417635) from *Escherichia coli* K12 has been published in Blattner et al., Science 277 (5331), 1453-1474, 1997, and its activity is being defined as tRNA pseudouridine 5S synthase. Accordingly, in one embodiment, the process of the present invention comprises the use of a gene product with an activity of *Escherichia coli* protein P35 superfamily, preferably a protein with the activity of a tRNA pseudouridine 5S synthase from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b3169 (Accession number NP_417638) from *Escherichia coli* K12 has been published in Blattner et al., Science 277 (5331), 1453-1474, 1997, and its activity is being defined as a transcription termination-antitermination factor. Accordingly, in one embodiment, the process of the present invention comprises the use of a gene product with an activity of *Escherichia coli* transcription factor nusA superfamily, preferably a protein with the activity of a transcription termination-antitermination factor from *E. coli* or its homolog, e.g. as shown herein, for the production of the fine chemical, meaning of glutamine and/or glutamate, in particular for increasing the amount of glutamine, in particular for increasing the amount of glutamate, in particular for increasing the amount of glutamine and glutamte, preferably glutamate and/or glutamine in free or bound form in an organism or a part thereof, as mentioned.

The sequence of b3231 (Accession number NP_417698) from *Escherichia coli* K12 has been published in Blattner et al., Science 277 (5331), 1453-1474, 1997, and its activity is being defined as a 50S ribosomal subunit protein L13. Accordingly, in one embodiment, the process of the present invention comprises the use of a gene product with an activity of *Escherichia coli* ribosomal protein L13 superfamily, preferably a protein with the activity of a 50S ribosomal subunit protein L13 from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b3619 (Accession number NP_418076) from *Escherichia coli* K12 has been published in Blattner et al., Science 277 (5331), 1453-1474, 1997, and its activity is being defined as a ADP-L-glycero-D-mannoheptose-6-epimerase, NAD(P)-binding. Accordingly, in one embodiment, the process of the present invention comprises the use of a gene product with an activity of ADPglyceromanno-heptose 6-epimerase, UDPglucose 4-epimerase homology superfamily, preferably a protein with the activity of a ADP-L-glycero-D-mannoheptose-6-epimerase, NAD(P)-binding from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of b3644 (Accession number NP_418101) from *Escherichia coli* K12 has been published in Blattner et al., Science 277 (5331), 1453-1474, 1997, and its activity is being defined as a uncharacterized stress-induced protein. Accordingly, in one embodiment, the process of the present invention comprises the use of a gene product with an activity of protein HI0467 superfamily, preferably a protein with the activity of a Uncharacterized stress-induced protein from *E. coli* or its homolog, e.g. as shown herein, for the production of the fine chemical, meaning of proline, in particular for increasing the amount of proline, preferably proline in free or bound form in an organism or a part thereof, as mentioned.

The sequence of b3680 (Accession number NP_418136) from *Escherichia coli* K12 has been published in Blattner et al., Science 277 (5331), 1453-1474, 1997, and its activity is being defined as a transcriptional regulator with homeodomain-like DNA binding domain (AraC/XylS family). Accordingly, in one embodiment, the process of the present invention comprises the use of a gene product with an activity of *Escherichia coli* b3680 protein, preferably a protein with the activity of a transcriptional regulator with homeodomain-like DNA binding domain (AraC/XylS family) from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b3791 (Accession number NP_418238) from *Escherichia coli* K12 has been published in Blattner et al., Science 277 (5331), 1453-1474, 1997, and its activity is being defined as a transaminase involved in lipopolysaccharide biosynthesis. Accordingly, in one embodiment, the process of the present invention comprises the use of a gene product with an activity of erythromycin resistance protein superfamily, preferably a protein with the activity of a transaminase involved in lipopolysaccharide biosynthesis from *E. coli* or its homolog, e.g. as shown herein, for the production of the fine chemical, meaning of glutamine and/or glutamate, in particular for increasing the amount of glutamine, in particular for increasing the amount of glutamate, in particular for increasing the amount of glutamine and glutamate, preferably glutamate and/or glutamine in free or bound form in an organism or a part thereof, as mentioned.

The sequence of b3919 (Accession number NP_418354) from *Escherichia coli* K12 has been published in Blattner et al., Science 277 (5331), 1453-1474, 1997, and its activity is being defined as a triosephosphate isomerase. Accordingly, in one embodiment, the process of the present invention comprises the use of a gene product with an activity of triosephosphate isomerase superfamily, preferably a protein with the activity of a triosephosphate isomerase from *E. coli* or its homolog, e.g. as shown herein, for the production of the fine chemical, meaning of proline, in particular for increasing the amount of proline, preferably proline in free or bound form in an organism or a part thereof, as mentioned.

The sequence of b3936 (Accession number NP_418371) from *Escherichia coli* K12 has been published in Blattner et al., Science 277 (5331), 1453-1474, 1997, and its activity is being defined as a 50S ribosomal subunit protein L32. Accordingly, in one embodiment, the process of the present invention comprises the use of a gene product with an activity of *Escherichia coli* ribosomal protein L31 superfamily, preferably a protein with the activity of a 50S ribosomal subunit protein L32 from *E. coli* or its homolog, e.g. as shown herein, for the production of the fine chemical, meaning of arginine, in particular for increasing the amount of arginine, preferably arginine in free or bound form in an organism or a part thereof, as mentioned.

The sequence of b4004 (Accession number NP_418432) from *Escherichia coli* K12 has been published in Blattner et al., Science 277 (5331), 1453-1474, 1997, and its activity is being defined as a transcriptional regulatory protein. Accordingly, in one embodiment, the process of the present invention comprises the use of a gene product with an activity of nitrogen assimilation regulatory protein ntrC or response regulator homology, RNA polymerase sigma factor interaction domain homology superfamily, preferably a protein with the activity of a transcriptional regulatory protein from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b4074 (Accession number NP_418498) from *Escherichia coli* K12 has been published in Blattner et al., Science 277 (5331), 1453-1474, 1997, and its activity is being defined as a cytochrome c-type biogenesis protein. Accordingly, in one embodiment, the process of the present invention comprises the use of a gene product with an activity of nrfE protein superfamily, preferably a protein with the activity of a Cytochrome c-type biogenesis protein from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b4133 (Accession number NP_418557) from *Escherichia coli* K12 has been published in Blattner et al., Science 277 (5331), 1453-1474, 1997, and its activity is being defined as a transcriptional activator of pH response (OmpR family). Accordingly, in one embodiment, the process of the present invention comprises the use of a gene product with an activity of b4133 protein, preferably a protein with the activity of a transcriptional activator of pH response (OmpR family) from *E. coli* or its homolog, e.g. as shown herein, for the production of the fine chemical, meaning of glutamine, in particular for increasing the amount of glutamine, preferably glutamine in free or bound form in an organism or a part thereof, as mentioned.

The sequence of b4346 (Accession number NP_418766) from *Escherichia coli* K12 has been published in Blattner et al., Science 277 (5331), 1453-1474, 1997, and its activity is being defined as a component of 5-methylcytosine-specific restriction enzyme McrBC. Accordingly, in one embodiment, the process of the present invention comprises the use of a gene product with an activity of 5-methylcytosine-specific restriction enzyme B superfamily, preferably a protein with the activity of a component of 5-methylcytosine-specific restriction enzyme McrBC from *E. coli* or its homolog, e.g. as shown herein, for the production of the fine chemical, meaning of glutamate, in particular for increasing the amount of glutamate, preferably glutamate in free or bound form in an organism or a part thereof, as mentioned.

The sequence of YFL019C (Accession number S48324.) from *Saccharomyces cerevisiae* has been published in Murakami et al., Nat. Genet. 10:261-268 (1995) and its activity is not been characterized yet. Accordingly, in one embodiment, the process of the present invention comprises the use of a gene product with an activity of a YFL019C protein from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

Homologues (=homologs) of the present gene products can be derived from any organisms as long as the homologue confers the herein mentioned activity, in particular, confers an increase in the respective fine chemical amount or content.

In one embodiment, the homolog of the any one of the polypeptides indicated in Table II, column 3, lines 30 to 33 for arginine
and/or lines 38 to 42 and/or 435 for glutamate
and/or lines 44 to 53 for proline
and/or lines 57 to 59 for glutamine, resp. is a homolog having the same or a similar activity, resp. In particular an increase of activity confers an increase in the content of the respective fine chemical in the organisms. In one embodiment, the homolog is a homolog with a sequence as indicated in Table I or II, column 7, lines 30 to 33 for arginine
and/or lines 38 to 42 and/or 435 for glutamate
and/or lines 44 to 53 for proline
and/or lines 57 to 59 for glutamine, resp. In one embodiment, the homolog of one of the polypeptides indicated in Table II, column 3, lines 30 to 33 for arginine
and/or lines 38 to 42 and/or 435 for glutamate
and/or lines 44 to 53 for proline
and/or lines 57 to 59 for glutamine resp., is derived from an eukaryotic. In one embodiment, the homolog is derived from Fungi. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is derived from Ascomyceta. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is derived from Saccharomycotina. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is derived from Saccharomycetes. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is a homolog being derived from Saccharomycetales. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is a homolog having the same or a similar activity being derived from Saccharomycetaceae. In one embodiment, the homolog of a polypeptide indicated in Table II, column 3, lines 30 to 33 for arginine
and/or lines 38 to 42 and/or 435 for glutamate
and/or lines 44 to 53 for proline
and/or lines 57 to 59 for glutamine, resp., is a homolog having the same or a similar activity being derived from Saccharomycetes.

In one embodiment, the homolog of the any one of the polypeptides indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine resp. is a homolog having the same or a similar activity. In particular an increase of activity confers an increase in the content of the respective fine chemical in the organisms. In one embodiment, the homolog is a homolog with a sequnence as indicated in Table I or II, column 7, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine, resp. In one embodiment, the homolog of one of the polypeptides indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is derived from an bacteria. In one embodiment, the homolog of a polypeptide indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is derived from Proteobacteria. In one embodiment, the homolog of a polypeptide indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is a homolog having the same or a similar activity being derived from Gammaproteobacteria. In one embodiment, the homolog of a polypeptide indicated in Table II, column 3, lines 34 to 37, 390, 405 and/or 430 for arginine and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is derived from Enterobacteriales. In one embodiment, the homolog of a polypeptide indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is a homolog being derived from Enterobacteriaceae. In one embodiment, the homolog of a polypeptide indicated in Table II, column 3, lines 34 to 37, 390, 405 and/or 430 for arginine and/or lines 43, 386, 387, 391, 396, 399 to 401, 403, 406, 413, 414, 417, 418, 421, 424, 427 and/or 434 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine is a homolog having the same or a similar activity and being derived from Escherichia.

Homologs of the polypeptide indicated in Table II, column 3, lines 30 to 62 and/or lines 386 to 435 may be the polypetides encoded by the nucleic acid molecules indicated in Table I, column 7, lines 30 to 62 and/or lines 386 to 435, resp., or may be the polypeptides indicated in Table II, column 7, lines 30 to 62 and/or lines 386 to 435, resp.

Further homologs of are described herein below.

In accordance with the invention, a protein or polypeptide has the "activity of an protein of the invention", e.g. the activity of a protein indicated in Table II, column 3, lines 34 to 37, 390, 405 and/or 430 for arginine
and/or lines 43, 386, 387, 391, 396, 399 to 401, 403, 406, 413, 414, 417, 418, 421, 424, 427, 434 and/or 435 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine resp.,
if its de novo activity, or its increased expression directly or indirectly leads to an increased arginine and/or glutamate and/or proline and/or glutamine, resp., in the organism or a part thereof, preferably in a cell of said organism. In a preferred embodiment, the protein or polypeptide has the above-mentioned additional activities of a protein indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Throughout the specification the activity or preferably the biological activity of such a protein or polypeptide or an nucleic acid molecule or sequence encoding such protein or polypeptide is identical or similar if it still has the biological or enzymatic activity of any one of the proteins indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or which has at least 10% of the original enzymatic activity, preferably 20%, particularly preferably 30%, most particularly preferably 40% in comparison to any one of the proteins indicated in Table II, column 3, lines 30 to 33 and/or lines 38 to 42 and/or 435 and/or lines 44 to 53 and/or lines 57 to 59 of Saccharomyces cerevisiae and/or any one of the proteins indicated in Table II, column 3, lines 34 to 37, 390, 405 and/or 430 and/or lines 43, 386, 387, 391, 396, 399 to 401, 403, 406, 413, 414, 417, 418, 421, 424, 427 and/or 434 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 of E. coli K12.

In accordance with the invention, a protein or polypeptide has the "activity of an protein of the invention", or of a protein as used in the invention, e.g. a protein having the activity of a protein indicated in Table II, column 3, lines 1 to 5 and/or lines 334 to 338 if its de novo activity, or its increased expression directly or indirectly leads to an increased methionine, preferably L-methionine level in the organism or a part thereof, preferably in a cell of said organism. In a preferred embodiment, the protein or polypeptide has the above-mentioned additional activities of a protein indicated in Table II, column 3, lines 1 to 5 and/or lines 334 to 338. During the specification the activity or preferably the biological activity of such a protein or polypeptide or an nucleic acid molecule or sequence encoding such protein or polypeptide is identical or similar if it still has the biological or enzymatic activity of any one of the proteins indicated in Table II, column 3, lines 1 to 5 and/or lines 334 to 338, i.e. if it has at least 10% of the original enzymatic activity, preferably 20%, particularly preferably 30%, most particularly preferably 40% in comparison to an any one of the proteins indicated in Table II, column 3, lines 1 to 4 of Saccharomyces cerevisiae and/or any one of the proteins indicated in Table II, column 3, line 5 and/or lines 334 to 338 of E. coli K12.

In one embodiment, the polypeptide of the invention or the polypeptide used in the method of the invention confers said activity, e.g. the increase of the fine chemical in an organism or a part thereof, if it is derived from an organism, which is evolutionary distant to the organism in which it is expressed. For example origin and expressing organism are derived from different families, orders, classes or phylums.

In one embodiment, the polypeptide of the invention or the polypeptide used in the method of the invention confers said activity, e.g. the increase of the fine chemical in an organism or a part thereof, if it is derived from an organism, which is evolutionary close to the organism indicated in Table I, column 4 and is expressed in an organism, which is evolutionary distant to the origin organism. For example origin and expressing organism are derived from different families, orders, classes or phylums whereas origin and the organism indicated in Table I, column 4 are derived from the same families, orders, classes or phylums.

The terms "increased", "rose", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change or the modulation of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild type cell. However, the terms increase or decrease as used herein also include the change or modulation of a property in the whole organism as mentioned.

Accordingly, the term "increase" or "decrease" means that the specific activity of an enzyme, preferably the amount of a compound or metabolite, e.g. of a polypeptide, a nucleic acid molecule or of the respective fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control, or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control, or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention. E.g., it differs by or in the expression level or activity of an protein having the activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or being encoded by a nucleic acid molecule indicated in Table I, column 5, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or its homologs, e.g. as indicated in Table I, column 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

its biochemical or genetical causes and therefore shows the increased amount of the respective fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of a protein, e.g. the polypeptide of the invention or the polypeptide used in the method of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by amplifying the number of gene(s), by modifying the regulation of the gene, or by increasing the stability of the corresponding mRNA or of the corresponding gene product encoded by the nucleic acid molecule of the invention or the nucleic acid molecule used in the method of the invention, or by introducing homologous genes from other organisms which are differently regulated, e.g. not feedback sensitive.

This also applies analogously to the combined increased expression of the nucleic acid molecule of the present invention or its gene product with that of further enzymes or regulators of the biosynthesis pathways of the respective fine chemical, e.g. which are useful for the synthesis of the respective fine chemicals.

The increase, decrease or modulation according to this invention can be constitutive, e.g. due to a stable permanent transgenic expression or to a stable mutation in the corresponding endogenous gene encoding the nucleic acid molecule of the invention or the nucleic acid molecule used in the method of the invention or to a modulation of the expression or of the behaviour of a gene conferring the expression of the polypeptide of the invention or the polypeptide used in the method of the invention, or transient, e.g. due to an transient transformation or temporary addition of a modulator such as a agonist or antagonist or inducible, e.g. after transformation with a inducible construct carrying the nucleic acid molecule of the invention or the nucleic acid molecule used in the method of the invention under control of a inducible promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the respective fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In case the activity of the *Escherichia coli* K12 protein b0695 or its homologs, as indicated in Table I, columns 5 or 7, line 35, e.g. a sensory histidine kinase in two-component signal transduction system (sensor kinase component), modification by phosphorylation, dephosphorylation, unspecified signal transduction, regulation of respiration, aerobic respiration, is increased, preferably, in one embodiment the increase of the fine chemical, preferably of arginine between 51% and 319% or more is conferred.

In case the activity of the *Escherichia coli* K12 protein b0730 or its homologs, as indicated in Table I, columns 5 or 7, line 43 or 54, e.g. a transcriptional regulator for regulation of C-compound and carbohydrate utilization, transcriptional control, prokaryotic nucleotide, transcriptional repressor, DNA binding, is increased, preferably, in one embodiment the increase of the fine chemical between 35% and 272%, preferably of glutamate between 55% and 115% and/or of proline between 35% and 272%, or more is conferred.

In case the activity of the *Escherichia coli* K12 protein b1284 or its homologs, as indicated in Table I, columns 5 or 7, line 36, e.g. a transcriptional regulator for regulation of C-compound and carbohydrate utilization, transcriptional control, transcriptional repressor, DNA binding, is increased, preferably, in one embodiment the increase of the fine chemical, preferably of arginine between 47% and 183% or more is conferred.

In case the activity of the *Escherichia coli* K12 protein b1827 or its homologs, e.g. as indicated in Table I, columns 5 or 7, line 56, e.g. a transcriptional repressor for transcriptional control, is increased, preferably, in one embodiment the increase of the fine chemical, preferably of proline between 42% and 126%, or more is conferred. In case the activity of the *Escherichia coli* K12 protein b1829 or its homologs, e.g. as indicated in Table I, columns 5 or 7, line 34 or 60, is increased, e.g. the activity of a heat shock protein with protease activity (htpx), involved in stress response, pheromone response, mating-type determination, sex-specific proteins, protein modification, proteolytic degradation is increased, preferably, in one embodiment the increase of the fine chemical between 45% and 1141%, preferably of glutamine between 50% and 68% and/or of arginine between 45% and 1141% or more is conferred.

In case the activity of the *Escherichia coli* K12 protein b1852 or its homologs, e.g. as indicated in Table I, columns 5 or 7, line 61, is increased, e.g. the activity of a glucose-6-phosphate dehydrogenase, involved in pentose-phosphate pathway oxidative branch, C-compound and carbohydrate utilization, NAD/NADP binding, nucleotide metabolism, metabolism of vitamins, cofactors, and prosthetic groups, energy is increased, preferably, in one embodiment the increase of the fine chemical, preferably of glutamine between 40% and 42% or more is conferred.

In case the activity of the *Escherichia coli* K12 protein b2095 or its homologs, e.g. as indicated in Table I, columns 5 or 7, line 37, is increased, e.g. the activity of a tagatose-6-phosphate kinase is increased, preferably, in one embodiment the increase of the fine chemical, preferably of arginine between 55% and 59% or more is conferred.

In case the activity of the *Escherichia coli* K12 protein b2699 or its homologs, e.g. as indicated in Table I, columns 5 or 7, line 55, is increased, e.g. the activity of a recombination protein recA, involved in DNA recombination and DNA repair, pheromone response, mating-type determination, sex-specific proteins, nucleotide binding is increased, preferably, in one embodiment the increase of the fine chemical, preferably of proline between 32% and 141% or more is conferred.

In case the activity of the *Escherichia coli* K12 protein b4265 or its homologs, e.g. as indicated in Table I, columns 5 or 7, line 62, is increased, e.g. the activity of a D-serine permease, involved in C-compound and carbohydrate transports, C-compound and carbohydrate utilization is increased, preferably, in one embodiment the increase of the fine chemical, preferably of glutamine between 32% and 47% or more is conferred.

In case the activity of the *Saccharomyces cerevisiae* protein YBR030W or its homologs, e.g. as indicated in Table I, columns 5 or 7, line 44, e.g. a "uncharacterized protein YBR030W", involved in C-compound and carbohydrate utilization, pentose-phosphate pathway and/or transcriptional control is increased, preferably, in one embodiment an increase of the fine chemical, preferably of proline between 51% and 282% or more is conferred.

In case the activity of the *Saccharomyces cerevisiae* protein YDL106C or its homologs, e.g. as indicated in Table I, columns 5 or 7, line 45, e.g. a homeobox proteins, involved in regulation of nucleotide metabolism, regulation of phosphate utilization, transcriptional control, nucleus is increased, preferably, in one embodiment an increase of the fine chemical, preferably of proline between 51% and 99% or more is conferred.

In case the activity of the *Saccaromyces* cerevisiae protein YFR0 42W or its homologs, e.g. as indicated in Table I, columns 5 or 7, line 58, e.g. a "protein required for cell viability in yeast" is increased, preferably, in one embodiment the increase of the fine chemical, preferably of glutamine, between 41% and 43% or more is conferred.

In case the activity of the *Saccharomyces cerevisiae* protein YGR135W or its homologs, e.g. as indicated in Table I, columns 5 or 7, line 50, e.g. a proteasome component Y13, involved in cytoplasmic and nuclear degradation, endoplasmic reticulum, nucleus, cell differentiation, proteasomal degradation is increased, preferably, in one embodiment an increase of the fine chemical, preferably of proline between 32% and 289% or more is conferred.

In case the activity of the *Saccharomyces cerevisiae* protein YHR130C or its homologs, e.g. as indicated in Table I, columns 5 or 7, line 31, e.g. a "hypothetical protein YBR030W" is increased, preferably, in one embodiment an increase of the fine chemical, preferably of arginine between 67% and 85% or more is conferred.

In case the activity of the *Saccharomyces cerevisiae* protein YIL150C or its homologs, as indicated in Table I, columns 5 or 7, line 51, e.g. a chromatin binding protein, required for S-phase (DNA synthesis) initiation or completion, involved in DNA synthesis and replication, mitotic cell cycle and cell cycle control, is increased, preferably, in one embodiment the increase of the fine chemical, preferably of proline between 33% and 304% or more is conferred.

In case the activity of the *Saccharomyces cerevisiae* protein YPR0 24W or its homologs e.g. as indicated in Table I, columns 5 or 7, line 41, e.g. a mitochondrial protein of the CDC48/PAS1/SEC18 family of ATPases, required for assembly of protein complexes, other proteolytic degradation, mitochondrion, protein folding and stabilization, is increased, preferably, in one embodiment the increase of the fine chemical, preferably of glutamate between 26% and 43% or more is conferred.

In case the activity of the *Saccharomyces cerevisiae* protein YPR133W-A or its homologs, e.g. as indicated in Table I, columns 5 or 7, line 42, e.g. a translocase of the outer mitochondrial membrane, is increased, preferably, in one embodiment the increase of the fine chemical, preferably of glutamate between 34% and 68% or more is conferred.

In case the activity of the *Saccharomyces cerevisiae* protein YPR138C or its homologs, e.g. as indicated in Table I, columns 5 or 7, line 53, e.g. a ammonium transport protein, involved in anion transports ($Cl^-$, $SO_4^{2-}$, $PO_4^{3-}$, etc.), other cation transports ($Na^+$, $K^+$, $Ca^{2+}$, $NH_4^+$, etc.), nitrogen and sulfur transport, cellular import, transport through plasma membrane, is increased, preferably, in one embodiment the increase of the fine chemical, preferably of proline between 54% and 520% or more is conferred.

In case the activity of the *Saccharomyces cerevisiae* protein YBR204C or its homologs, e.g. as indicated in Table I, columns 5 or 7, line 38, e.g. a peroxisomal lipase, involved in breakdown of lipids, fatty acids and isoprenoids, peroxisome, is increased, preferably, in one embodiment the increase of the fine chemical, preferably of glutamate between 55% and 76% or more is conferred.

In case the activity of the *Saccharomyces cerevisiae* protein YDR271C or its homologs, e.g. as indicated in Table I, columns 5 or 7, line 46, e.g. a "hypothetical protein YDR271C" is increased, preferably, in one embodiment an increase of the fine chemical, preferably of proline, between 36% and 482% or more is conferred.

In case the activity of the *Saccharomyces cerevisiae* protein YDR316W or its homologs, e.g. as indicated in Table I, columns 5 or 7, line 30, e.g. a S-adenosylmethionine-dependent methyltransferase is increased, preferably, in one embodiment the increase of the fine chemical, preferably of arginine between 45% and 102% or more is conferred.

In case the activity of the *Saccharomyces cerevisiae* protein YEL045C or its homologs, e.g. as indicated in Table I, columns 5 or 7, line 47, e.g. a "hypothetical protein YBR030W" is increased, preferably, in one embodiment the increase of the fine chemical, preferably of proline between 41% and 89% or more is conferred.

In case the activity of the *Saccharomyces cerevisiae* protein YER173w or its homologs, e.g. as indicated in Table I, columns 5 or 7, line 48 or 57, e.g. a checkpoint protein, involved in the activation of the DNA damage and meiotic pachytene checkpoints; DNA recombination and DNA repair, cell cycle checkpoints (checkpoints of morphogenesis, DNA-damage, -replication, mitotic phase and spindle), nucleic acid binding, DNA synthesis and replication is increased, preferably, in one embodiment the increase of the fine chemical between 34% and 285%, preferably of glutamine between 86% and 285% and/or of proline between 34% and 191% or more is conferred.

In case the activity of the *Saccharomyces cerevisiae* protein YFL013C or its homologs, e.g. as indicated in Table I, columns 5 or 7, line 39, e.g. a "subunit of the INO80 chromatin remodeling complex" is increased, preferably, in one embodiment an increase of the fine chemical, preferably of glutamate, between 81% and 134% or more is conferred.

In case the activity of the *Saccharomyces cerevisiae* protein YFL050C or its homologs, e.g. as indicated in Table I, columns 5 or 7, line 49, e.g. a di-, tri-valent inorganic cation transporte, involved in heavy metal ion transports (Cu, Fe, etc.), cellular import, detoxification, homeostasis of metal ions (Na, K, Ca etc.), transport through plasma membrane is increased, preferably, in one embodiment an increase of the fine chemical, preferably of proline, between 44% and 74% or more is conferred.

In case the activity of the *Saccharomyces cerevisiae* protein YGR104C or its homologs, e.g. as indicated in Table I, columns 5 or 7, line 40, e.g. a "RNA polymerase II suppressor protein SRB5—yeast and/or suppressor of RNA polymerase B SRB5" involved in transcription activities is increased, preferably, in one embodiment the increase of the fine chemical, preferably of glutamate, between 64% and 96% or more is conferred.

In case the activity of the *Saccharomyces cerevisiae* protein YKR057W or its homologs, e.g. as indicated in Table I, columns 5 or 7, line 32 or 59, e.g. a ribosomal protein, similar to S21A, S26A and/or YS25 ribosomal proteins, involved in ribosome biogenesis, cell differentiation and translation is increased, preferably, in one embodiment an increase of the fine chemical between 41% and 457%, preferably of glutamine between 41% and 284% and/or of arginine between 57% and 457% or more is conferred. In case the activity of the *Escherichia coli* K12 protein b0050 or its homologs e.g. a conserved protein potentially involved in protein interaction e.g. as indicated in Table II, columns 5 or 7, line 386, is increased, preferably, in one embodiment the increase of the fine chemical, preferably of glutamate between 37% and 97% or more is conferred.

In case the activity of the *Escherichia coli* K12 protein b0057 or its homologs e.g. a protein as indicated in Table II, columns 5 or 7, line 387, is increased, preferably, in one embodiment the increase of the fine chemical, preferably of glutamate between 35% and 83% or more is conferred. The sequence of b0057 (Accession number NP_414599) from *Escherichia coli* K12 has been published in Blattner et al., Science 277 (5331), 1453-1474, 1997, and its activity is not been characterized yet.

Accordingly, in one embodiment, the process of the present invention comprises the use of a gene product with an activity of b0057 protein from *E. coli* or its homolog, e.g. as shown herein, for the production of the fine chemical, meaning of glutamate in particular for increasing the amount of glutamate, preferably glutamate in free or bound form in an organism or a part thereof, as mentioned.

In case the activity of the *Escherichia coli* K12 protein b0149 or its homologs e.g. a bifunctional penicillin-binding protein 1b: glycosyl transferase (N-terminal); transpeptidase (C-terminal) e.g. as indicated in Table II, columns 5 or 7, line 389, is increased, preferably, in one embodiment the increase of the fine chemical, preferably of proline between 33% and 120% or more is conferred.

In case the activity of the *Escherichia coli* K12 protein b0161 or its homologs e.g. a periplasmic serine protease e.g. as indicated in Table II, columns 5 or 7, lines 390 to 392, is increased, preferably, in one embodiment the increase of the fine chemical, preferably of arginine between 628% and 881% or more, preferably of glutamate between 35% and 65% or more, preferably of glutamine between 43% and 256% or more, preferably of arginine and glutamate between 35% and 881% or more, preferably of arginine and glutamine between 43% and 881% or more, preferably of glutamate and glutamine between 35% and 256% or more, preferably of arginine and glutamate and glutamine between 35% and 881% or more is conferred.

In case the activity of the *Escherichia coli* K12 protein b0486 or its homologs e.g. a amino-acid/amine transport protein (APC family) e.g. as indicated in Table II, columns 5 or 7, line 393, is increased, preferably, in one embodiment the increase of the fine respective chemical, preferably of glutamine between 51% and 128% or more, is conferred.

In case the activity of the *Escherichia coli* K12 protein b0849 or its homologs e.g. a glutaredoxin 1 redox coenzyme for glutathione-dependent ribonucleotide reductase e.g. as indicated in Table II, columns 5 or 7, line 394, is increased, preferably, in one embodiment the increase of the fine chemical, preferably of glutamine between 37% and 50% or more is conferred.

In case the activity of the *Escherichia coli* K12 protein b0970 or its homologs e.g. a glutamate receptor e.g. as indicated in Table II, columns 5 or 7, line 395, is increased, preferably, in one embodiment the increase of the fine respective chemical, preferably of glutamine between 59% and 380% or more, is conferred.

In one embodiment, in case the activity of the *Escherichia coli* K12 protein b1343 or its homologs, e.g. as indicated in Table II, columns 5 or 7, line 396 and 397, is increased, e.g. the activity of a protein involved in rRNA processing and/or translation is increased, preferred the activity of a ATP-dependent RNA helicase, stimulated by 23S rRNA or its homolog is increased. Preferably, an increase of the respective fine chemical preferably of glutamine between 37% and 39% or more is conferred, preferably of glutamate between 48% and 99% or more is conferred, preferably of glutamine and glutamate between 37% and 99% or more is conferred.

In case the activity of the *Escherichia coli* K12 protein b1360 or a protein with the activity defined as putative DNA replication protein or its homologs, e.g. transcriptional regulator, e.g. as indicated in Table II, columns 5 or 7, line 398 is increased, preferably, in one embodiment an increase of the fine chemical, preferably of proline between 33% and 70% or more is conferred.

In case the activity of the *Escherichia coli* K12 protein b1693 or its homologs e.g. a 3-dehydroquinate dehydratase e.g. as indicated in Table II, columns 5 or 7, line 399, is increased, preferably, in one embodiment the increase of the fine chemical, preferably of glutamate between 39% and 149% or more is conferred.

In case the activity of the *Escherichia coli* K12 protein b1736 or its homologs e.g. a PEP-dependent phosphotransferase enzyme, e.g. as indicated in Table II, columns 5 or 7, line 400, is increased, preferably, in one embodiment the increase of the fine chemical, preferably of glutamate between 46% and 97% or more is conferred.

In one embodiment, in case the activity of the *Escherichia coli* K12 protein b1738 or a protein with the activity defined as PEP-dependent phosphotransferase or its homologs, e.g. as indicated in Table II, columns 5 or 7, line 401, is increased, preferably, in one embodiment an increase of the fine chemical preferably of glutamate between 38% and 107% or more is conferred.

In one embodiment, in case the activity of the *Escherichia coli* K12 protein b1886 or a methyl-accepting chemotaxis protein II, aspartate sensor receptor or its homologs, e.g. as indicated in Table II, columns 5 or 7, line 402, is increased, preferably, in one embodiment an increase of the fine chemical preferably of glutamine between 36% and 124% or more is conferred.

In one embodiment, in case the activity of the *Escherichia coli* K12 protein b1896 or a trehalose-6-phosphate synthase or its homologs, e.g. as indicated in Table II, columns 5 or 7, line 403, is increased, preferably, in one embodiment an increase of the fine chemical preferably of glutamate between 67% and 162% or more is conferred.

In one embodiment, in case the activity of the *Escherichia coli* K12 protein b1926 or a flagellar protein fliT or its homologs, e.g. as indicated in Table II, columns 5 or 7, line 404, is increased, preferably, in one embodiment an increase of the fine chemical preferably of glutamine between 7% and 27% or more is conferred.

In one embodiment, in case the activity of the *Escherichia coli* K12 protein b2307 or a histidine and lysine/arginine/ornithine transport protein (ABC superfamily, membrane) or its homologs, e.g. as indicated in Table II, columns 5 or 7, line 405 and 406, is increased, preferably, in one embodiment an increase of the fine chemical, preferably of arginine between 95% and 247% or more, preferably of glutamate between 35% and 89% or more, preferably of arginine and glutamatne between 35 and 247% or more is conferred.

In one embodiment, in case the activity of the *Escherichia coli* K12 protein b2414 or its homologs, e.g. as indicated in Table II, columns 5 or 7, line 407, is increased, e.g. the activity of a protein of the threonine dehydratase-superfamily is increased preferably the activity of a protein involved in amino acid biosynthesis, biosynthesis of the cysteine-aromatic group, degradation of amino acids of the cysteine-aromatic group, nitrogen and sulfur utilization biosynthesis of the aspartate family, degradation of amino acids of the aspartate group, biosynthesis of sulfuric acid and L-cysteine derivatives, biosynthesis of secondary products derived from primary amino acids, biosynthesis of secondary products derived from glycine, L-serine and L-alanine, pyridoxal phosphate binding is increased, preferred the activity of a subunit of cysteine synthase A and O-acetylserine sulfhydrolase A, PLP-dependent enzyme or its homolog is increased. Preferably, an increase of the respective fine chemical, preferably of glutamine between 30% and 56% or more is conferred.

In one embodiment, in case the activity of the *Escherichia coli* K12 protein b2426 or its homologs, e.g. as indicated in Table II, columns 5 or 7, line 408, is increased, e.g. the activity of a oxidoreductase with NAD(P)-binding domain is increased. Preferably, an increase of the respective fine chemical, preferably of glutamine between 31% and 62% or more is conferred.

In one embodiment, in case the activity of the *Escherichia coli* K12 protein b2489 or its homologs, e.g. as indicated in Table II, columns 5 or 7, line 409, is increased, e.g. the activity of a hydrogenase Fe—S subunit is increased. Preferably, an increase of the respective fine chemical, preferably of glutamine between 33% and 44% or more is conferred.

In one embodiment, in case the activity of the *Escherichia coli* K12 protein b2553 or its homologs, e.g. as indicated in Table II, columns 5 or 7, line 410 and 411, is increased, e.g. the activity of a regulatory protein P-II for glutamine synthetase is increased. Preferably, an increase of the respective fine chemical, preferably of glutamine between 55% and 90% or more, preferably of proline between 49% and 68% or more, preferably of glutamine and proline between 49% and 90% or more is conferred.

In one embodiment, in case the activity of the *Escherichia coli* K12 protein b2664 or its homologs, e.g. as indicated in Table II, columns 5 or 7, line 412, is increased, e.g. the activity of a hydrogenase Fe—S subunit is increased. Preferably, an increase of the respective fine chemical, preferably of proline between 35% and 853% or more is conferred.

In case the activity of the *Escherichia coli* K12 protein b2710 or its homologs e.g. a flavorubredoxin (FlRd) bifunctional NO and $O_2$ reductase e.g. as indicated in Table II, columns 5 or 7, line 413, is increased, preferably, in one embodiment the increase of the fine chemical, preferably of glutamate between 35% and 38% or more is conferred.

In one embodiment, in case the activity of the *Escherichia coli* K12 protein b2818 or its homologs, e.g. as indicated in Table I, columns 5 or 7, line 414 and 415, is increased, e.g. the activity of a N-acetylglutamate synthase (amino acid N-acetyltransferase is increased. Preferably, an increase of the respective fine chemical, preferably of glutamate between 50% and 129% or more, preferably of glutamine between 45% and 519% or more, preferably of glutamate and glutamine between 45% and 519% or more is conferred.

In case the activity of the *Escherichia coli* K12 protein b3064 or its homologs e.g. a putative O-sialoglycoprotein endopeptidase, with actin-like ATPase domain e.g. as indicated in Table II, columns 5 or 7, line 416, is increased, preferably, in one embodiment the increase of the fine chemical, preferably of glutamine between 72% and 141% or more is conferred.

In case the activity of the *Escherichia coli* K12 protein b3074 or its homologs, e.g. as indicated in Table II, columns 5 or 7, line 417, is increased, e.g. the activity of a tRNA synthetase is increased, preferably, an increase of the respective fine chemical, preferably of glutamate between 34% and 85% or more is conferred.

In case the activity of the *Escherichia coli* K12 protein b3116 or its homologs, e.g. as indicated in Table II, columns 5 or 7, line 418, is increased, e.g. the activity of a L-threonine/L-serine permease, anaerobically inducible (HAAAP family) is increased, preferably, an increase of the respective fine chemical, preferably of glutamate between 35% and 98% or more is conferred.

In case the activity of the *Escherichia coli* K12 protein b3160 or its homologs, e.g. as indicated in Table II, columns 5 or 7, line 419, is increased, e.g. the activity of a monooxygenase with luciferase-like ATPase activity is increased, preferably, an increase of the respective fine chemical, preferably of glutamine between 38% and 189% or more is conferred.

In case the activity of the *Escherichia coli* K12 protein b3166 or its homologs e.g. a tRNA pseudouridine 5S synthase e.g. as indicated in Table II, columns 5 or 7, line 420, is increased, preferably, in one embodiment the increase of the fine chemical, preferably of glutamine between 29% and 40% or more is conferred.

In case the activity of the *Escherichia coli* K12 protein b3169 or its homologs e.g. a transcription termination-antitermination factor e.g. as indicated in Table II, columns 5 or 7, line 421 and 422, is increased, preferably, in one embodiment the increase of the fine chemical, preferably of glutamine between 55% and 111% or more, preferably of glutamate between 42% and 140% or more, preferably of glutamine and glutamate between 42% and 140% or more is conferred.

In case the activity of the *Escherichia coli* K12 protein b3231 or its homologs e.g. a 50S ribosomal subunit protein L13 e.g. as indicated in Table II, columns 5 or 7, line 423, is increased, preferably, in one embodiment the increase of the fine chemical, preferably of glutamine between 50% and 164% or more is conferred.

In case the activity of the *Escherichia coli* K12 protein b3619 or its homologs e.g. a ADP-L-glycero-D-mannoheptose-6-epimerase, NAD(P)-binding e.g. as indicated in Table II, columns 5 or 7, line 424, is increased, preferably, in one embodiment the increase of the fine chemical, preferably of glutamate between 40% and 122% or more is conferred.

In case the activity of the *Escherichia coli* K12 protein b3644 or its homologs e.g. an uncharacterized stress-induced protein e.g. as indicated in Table II, columns 5 or 7, line 425, is increased, preferably, in one embodiment the increase of the fine chemical, preferably of proline between 32% and 241% or more is conferred.

In case the activity of the *Escherichia coli* K12 protein b3680 or its homologs e.g. an uncharacterized stress-induced protein e.g. as indicated in Table II, columns 5 or 7, line 426, is increased, preferably, in one embodiment the increase of the fine chemical, preferably of glutamine between 50% and 199% or more is conferred.

In case the activity of the *Escherichia coli* K12 protein b3791 or its homologs e.g. an uncharacterized stress-induced protein e.g. as indicated in Table II, columns 5 or 7, line 427 and 428, is increased, preferably, in one embodiment the increase of the fine chemical, preferably of glutamine between 28% and 57% or more, preferably of glutamate between 39% and 57% or more, preferably of glutamine and glutamate between 28% and 57% or more is conferred.

In case the activity of the *Escherichia coli* K12 protein b3919 or its homologs e.g. an triosephosphate isomerase e.g. as indicated in Table II, columns 5 or 7, line 429, is increased, preferably, in one embodiment the increase of the fine chemical, preferably of proline between 35% and 118% or more is conferred.

In case the activity of the *Escherichia coli* K12 protein b3936 or its homologs e.g. an 50S ribosomal subunit protein L32 e.g. as indicated in Table II, columns 5 or 7, line 430, is increased, preferably, in one embodiment the increase of the fine chemical, preferably of arginine between 120% and 398% or more is conferred.

In case the activity of the *Escherichia coli* K12 protein b4004 or its homologs e.g. a transcriptional regulatory protein e.g. as indicated in Table II, columns 5 or 7, line 431, is increased, preferably, in one embodiment the increase of the fine chemical, preferably of glutamine between 30% and 36% or more is conferred.

In case the activity of the *Escherichia coli* K12 protein b4074 or its homologs e.g. a cytochrome c-type biogenesis protein e.g. as indicated in Table II, columns 5 or 7, line 432, is increased, preferably, in one embodiment the increase of the fine chemical, preferably of glutamine between 40% and 42% or more is conferred.

In case the activity of the *Escherichia coli* K12 protein b4133 or its homologs e.g. a transcriptional activator of pH response (OmpR family) e.g. as indicated in Table II, columns 5 or 7, line 433, is increased, preferably, in one embodiment the increase of the fine chemical, preferably of glutamine between 59% and 212% or more is conferred.

In case the activity of the *Escherichia coli* K12 protein b4346 or its homologs e.g. a component of 5-methylcytosine-specific restriction enzyme McrBC e.g. as indicated in Table II, columns 5 or 7, line 434, is increased, preferably, in one embodiment the increase of the fine chemical, preferably of glutamate between 38% and 44% or more is conferred.

In case the activity of the *Saccharomyces cerevisiae* protein YFL019C or its homologs e.g. a protein as indicated in Table II, columns 5 or 7, line 435, is increased, preferably, in one embodiment the increase of the fine chemical, preferably of glutamate between 81% and 134% or more is conferred. The sequence of YFL019C (Accession number S48324.) from *Saccharomyces cerevisiae* has been published in Murakami et al., Nat. Genet. 10:261-268 (1995) and its activity is not been characterized yet. Accordingly, in one embodiment, the process of the present invention comprises the use of a gene product with an activity of a YFL019C protein from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

In case the activity of the *Escherichia coli* K12 protein b0695 or its homologs, e.g. as indicated in Table I, columns 5 or 7, line 35, e.g. a sensory histidine kinase is increased, preferably an increase of the fine chemical and of phenylalanine is conferred.

In case the activity of the *Escherichia coli* K12 protein b0730 or its homologs, e.g. as indicated in Table I, columns 5 or 7, line 43 or 54, e.g. a transcriptional regulator is increased, preferably an increase of the fine chemical and of fumerate is conferred.

In case the activity of the *Escherichia coli* K12 protein b1284 or its homologs, e.g. as indicated in Table I, columns 5 or 7, line 36, e.g. a transcriptional regulator is increased, preferably an increase of the fine chemical and of fumaric acid is conferred.

In case the activity of the *Escherichia coli* K12 protein b1827 or its homologs, e.g. as indicated in Table I, columns 5 or 7, line 56, e.g. a transcriptional repressor is increased, preferably an increase of the fine chemical and of isoleucince is conferred.

In case the activity of the *Escherichia coli* K12 protein b1829 or its homologs, e.g. as indicated in Table I, columns 5 or 7, line 34 or 60, is increased, e.g. the activity of a heat shock protein with protease activity (htpx is increased, preferably an increase of the fine chemical and of isoleucine is conferred.

In case the activity of the *Escherichia coli* K12 protein b1852 or its homologs, e.g. as indicated in Table I, columns 5 or 7, line 61, is increased, e.g. the activity of a glucose-6-phosphate dehydrogenase is increased, preferably an increase of the fine chemical and of myoinositol is conferred.

In case the activity of the *Escherichia coli* K12 protein b2095 or its homologs, e.g. as indicated in Table I, columns 5 or 7, line 37, is increased, e.g. the activity of a tagatose-6-phosphate kinase is increased preferably an increase of the fine chemical and of alanine is conferred.

In case the activity of the *Escherichia coli* K12 protein b2699 or its homologs, e.g. as indicated in Table I, columns 5 or 7, line 55, is increased, e.g. the activity of a recombination protein recA is increased, preferably an increase of the fine chemical and of fumerate is conferred.

In case the activity of the *Saccaromyces* cerevisiae protein YFR042W or its homologs, e.g. as indicated in Table I, columns 5 or 7, line 58, e.g. a "protein required for cell viability in yeast" is increased, preferably an increase of the fine chemical and of Leucine is conferred.

In case the activity of the *Saccharomyces cerevisiae* protein YHR130C or its homologs, e.g. as indicated in Table I, columns 5 or 7, line 31, e.g. a "uncharacterized protein YHR130C" is increased, preferably an increase of the fine chemical and of phenylalanine is conferred.

In case the activity of the *Saccharomyces cerevisiae* protein YIL150C or its homologs, e.g. as indicated in Table I, columns 5 or 7, line 51, e.g. a chromatin binding protein is increased, preferably an increase of the fine chemical and of valine is conferred.

In case the activity of the *Saccharomyces cerevisiae* protein YPR024W or its homologs, e.g. as indicated in Table I, columns 5 or 7, line 41, e.g. a mitochondrial protein of the CDC48/PAS1/SEC18 family of ATPases is increased, preferably an increase of the fine chemical and of fumerate is conferred.

In case the activity of the *Saccharomyces cerevisiae* protein YPR138C or its homologs, e.g. as indicated in Table I, columns 5 or 7, line 53, e.g. a ammonium transport protein is increased, preferably an increase of the fine chemical and of phenylalanine is conferred.

In case the activity of the *Saccharomyces cerevisiae* protein YBR204C or its homologs, e.g. as indicated in Table I, columns 5 or 7, line 38, e.g. a peroxisomal lipase is increased, preferably an increase of the fine chemical and of inositol is conferred.

In case the activity of the *Saccharomyces cerevisiae* protein YDR271C or its homologs, e.g. as indicated in Table I, columns 5 or 7, line 46, e.g. a "uncharacterized protein YDR271C" is increased, preferably an increase of the fine chemical and of isoleucine is conferred.

In case the activity of the *Saccharomyces cerevisiae* protein YER173W or its homologs, e.g. as indicated in Table I, columns 5 or 7, line 48 or 57, e.g. a checkpoint protein is increased, preferably an increase of the fine chemical and of valine is conferred.

In case the activity of the *Saccharomyces cerevisiae* protein YFL013C or its homologs, e.g. as indicated in Table I, columns 5 or 7, line 39, e.g. a "subunit of the INO80 chromatin remodeling complex" is increased, preferably an increase of the fine chemical and of valine is conferred.

In case the activity of the *Saccharomyces cerevisiae* protein YFL050C or its homologs, e.g. as indicated in Table I, columns 5 or 7, line 49, e.g. a di-, tri-valent inorganic cation transporter is increased, preferably an increase of the fine chemical and of threonine is conferred.

In case the activity of the *Saccharomyces cerevisiae* protein YGR104c or its homologs, e.g. as indicated in Table I, columns 5 or 7, line 40, e.g. a "RNA polymerase II suppressor protein SRB5—yeast and/or suppressor of RNA polymerase B SRB5" is increased, preferably an increase of the fine chemical and of isoleucine is conferred.

In case the activity of the *Saccharomyces cerevisiae* protein YKR057W or its homologs, e.g. as indicated in Table I, columns 5 or 7, line 32 or 59, e.g. a ribosomal protein, similar to S21A, S26A and/or YS25 ribosomal proteins is increased, preferably an increase of the fine chemical and of threonine is conferred.

In case the activity of the *Escherichia coli* K12 protein b0050 or its homologs e.g. a conserved protein potentially involved in protein interaction e.g. as indicated in Table II, columns 5 or 7, line 386, is increased, preferably, in one embodiment the increase of the fine chemical, preferably of glutamate and of an other amino acid or more is conferred.

In case the activity of the *Escherichia coli* K12 protein b0057 or its homologs e.g. a protein as indicated in Table II, columns 5 or 7, line 387, is increased, preferably, in one embodiment the increase of the fine chemical, preferably of glutamate and of an other amino acid or more is conferred. The sequence of b0057 (Accession number NP_414599) from *Escherichia coli* K12 has been published in Blattner et al., Science 277 (5331), 1453-1474, 1997, and its activity is not been characterized yet.

Accordingly, in one embodiment, the process of the present invention comprises the use of a gene product with an activity of b0057 protein from *E. coli* or its homolog, e.g. as shown herein, for the production of the fine chemical, meaning of glutamate in particular for increasing the amount of glutamate, preferably glutamate in free or bound form in an organism or a part thereof, as mentioned.

In case the activity of the *Escherichia coli* K12 protein b0138 or its homologs e.g. a fimbrial-like adhesin protein e.g. as indicated in Table II, columns 5 or 7, line 388, is increased, preferably, in one embodiment the increase of the fine chemical, preferably of proline and of one or more other amino acid(s) or more is conferred.

In case the activity of the *Escherichia coli* K12 protein b0149 or its homologs e.g. a bifunctional penicillin-binding protein 1b: glycosyl transferase (N-terminal); transpeptidase (C-terminal) e.g. as indicated in Table II, columns 5 or 7, line 389, is increased, preferably, in one embodiment the increase of the fine chemical, preferably of proline and of one or more other amino acid(s)o(s) is conferred.

In case the activity of the *Escherichia coli* K12 protein b0161 or its homologs e.g. a periplasmic serine protease e.g. as indicated in Table II, columns 5 or 7, lines 390 to 392, is increased, preferably, in one embodiment the increase of the fine chemical, preferably of arginine and/or of glutamate and/or of glutamine and of one or more other amino acid(s) is conferred.

In case the activity of the *Escherichia coli* K12 protein b0486 or its homologs e.g. a amino-acid/amine transport protein (APC family) e.g. as indicated in Table II, columns 5 or 7, line 393, is increased, preferably, in one embodiment the increase of the fine respective chemical, preferably of glutamine and of one or more other amino acid(s) is conferred.

In case the activity of the *Escherichia coli* K12 protein b0849 or its homologs e.g. a glutaredoxin 1 redox coenzyme for glutathione-dependent ribonucleotide reductase e.g. as indicated in Table II, columns 5 or 7, line 394, is increased, preferably, in one embodiment the increase of the fine chemical, preferably of glutamine and of one or more other amino acid(s) is conferred.

In case the activity of the *Escherichia coli* K12 protein b0970 or its homologs e.g. a glutamate receptor e.g. as indicated in Table II, columns 5 or 7, line 395, is increased, preferably, in one embodiment the increase of the fine respective chemical, preferably of glutamine and of one or more other amino(s) acid(s) is conferred.

In one embodiment, in case the activity of the *Escherichia coli* K12 protein b1343 or its homologs, e.g. as indicated in Table II, columns 5 or 7, line 396 and 397, is increased, e.g. the activity of a protein involved in rRNA processing and/or translation is increased, preferred the activity of a ATP-dependent RNA helicase, stimulated by 23S rRNA or its homolog is increased. Preferably, an increase of the respective fine chemical preferably of glutamine and/or of glutamate and of one or more other amino acid(s) is conferred.

In case the activity of the *Escherichia coli* K12 protein b1360 or a protein with the activity defined as putative DNA replication protein or its homologs, e.g. transcriptional regulator, e.g. as indicated in Table II, columns 5 or 7, line 398 is increased, preferably, in one embodiment an increase of the fine chemical, preferably of proline between and of one or more other amino acid(s) conferred.

In case the activity of the *Escherichia coli* K12 protein b1693 or its homologs e.g. a 3-dehydroquinate dehydratase e.g. as indicated in Table II, columns 5 or 7, line 399, is increased, preferably, in one embodiment the increase of the fine chemical, preferably of glutamate and of one or more other amino acid(s) is conferred.

In case the activity of the *Escherichia coli* K12 protein b1736 or its homologs e.g. a PEP-dependent phosphotransferase enzyme, e.g. as indicated in Table II, columns 5 or 7, line 400, is increased, preferably, in one embodiment the increase of the fine chemical, preferably of glutamate and of one or more other amino acid(s) is conferred.

In one embodiment, in case the activity of the *Escherichia coli* K12 protein b1738 or a protein with the activity defined as PEP-dependent phosphotransferase or its homologs, e.g. as indicated in Table II, columns 5 or 7, line 401, is increased, preferably, in one embodiment an increase of the fine chemical preferably of glutamate and of one or more other amino acid(s) is conferred.

In one embodiment, in case the activity of the *Escherichia coli* K12 protein b1886 or a methyl-accepting chemotaxis protein II, aspartate sensor receptor or its homologs, e.g. as indicated in Table II, columns 5 or 7, line 402, is increased, preferably, in one embodiment an increase of the fine chemical preferably of glutamine and of one or more other amino acid(s) is conferred.

In one embodiment, in case the activity of the *Escherichia coli* K12 protein b1896 or a trehalose-6-phosphate synthase or its homologs, e.g. as indicated in Table II, columns 5 or 7, line 403, is increased, preferably, in one embodiment an increase of the fine chemical preferably of glutamate and of one or more other amino acid(s) is conferred.

In one embodiment, in case the activity of the *Escherichia coli* K12 protein b1926 or a flagellar protein fliT or its homologs, e.g. as indicated in Table II, columns 5 or 7, line 404, is increased, preferably, in one embodiment an increase of the fine chemical preferably of glutamine and of one or more other amino acid(s) is conferred.

In one embodiment, in case the activity of the *Escherichia coli* K12 protein b2307 or a flagellar protein fliT or its homologs, e.g. as indicated in Table II, columns 5 or 7, line 405 and 406, is increased, preferably, in one embodiment an increase of the fine chemical, preferably of arginine and/or of glutamate and of one or more other amino acid(s) is conferred.

In one embodiment, in case the activity of the *Escherichia coli* K12 protein b2414 or its homologs, e.g. as indicated in Table II, columns 5 or 7, line 407, is increased, e.g. the activity of a protein of the threonine dehydratase-superfamily is increased preferably the activity of a protein involved in amino acid biosynthesis, biosynthesis of the cysteine-aromatic group, degradation of amino acids of the cysteine-aromatic group, nitrogen and sulfur utilizationbiosynthesis of the aspartate family, degradation of amino acids of the aspartate group, biosynthesis of sulfuric acid and L-cysteine derivatives, biosynthesis of secondary products derived from primary amino acids, biosynthesis of secondary products derived from glycine, L-serine and L-alanine, pyridoxal phosphate binding is increased, preferred the activity of a subunit of cysteine synthase A and O-acetylserine sulfhydrolase A, PLP-dependent enzyme or its homolog is increased. Preferably, an increase of the respective fine chemical, preferably of glutamine and of one or more other amino acid(s) is conferred.

In one embodiment, in case the activity of the *Escherichia coli* K12 protein b2426 or its homologs, e.g. as indicated in Table II, columns 5 or 7, line 408, is increased, e.g. the activity of a oxidoreductase with NAD(P)-binding domain is increased. Preferably, an increase of the respective fine chemical, preferably of glutamine and of one or more other amino acid(s) is conferred.

In one embodiment, in case the activity of the *Escherichia coli* K12 protein b2489 or its homologs, e.g. as indicated in Table II, columns 5 or 7, line 409, is increased, e.g. the activity of a hydrogenase Fe—S subunit is increased. Preferably, an increase of the respective fine chemical, preferably of glutamine and of one or more other amino acid(s) is conferred.

In one embodiment, in case the activity of the *Escherichia coli* K12 protein b2553 or its homologs, e.g. as indicated in Table II, columns 5 or 7, line 410 and 411, is increased, e.g. the activity of a regulatory protein P-II for glutamine synthetase is increased. Preferably, an increase of the respective fine chemical, preferably of glutamine and/or of proline and of one or more other amino acid(s) is conferred.

In one embodiment, in case the activity of the *Escherichia coli* K12 protein b2644 or its homologs, e.g. as indicated in Table II, columns 5 or 7, line 412, is increased, e.g. the activity of a hydrogenase Fe—S subunit is increased. Preferably, an increase of the respective fine chemical, preferably of proline and of one or more other amino acid(s) is conferred.

In case the activity of the *Escherichia coli* K12 protein b2710 or its homologs e.g. a flavorubredoxin (FlRd) bifunctional NO and $O_2$ reductase e.g. as indicated in Table II, columns 5 or 7, line 413, is increased, preferably, in one embodiment the increase of the fine chemical, preferably of glutamate and of one or more other amino acid(s) is conferred.

In one embodiment, in case the activity of the *Escherichia coli* K12 protein b2818 or its homologs, e.g. as indicated in Table I, columns 5 or 7, line 414 and 415, is increased, e.g. the activity of a N-acetylglutamate synthase (amino acid N-acetyltransferase is increased. Preferably, an increase of the respective fine chemical, preferably of glutamate and/or of glutamine and of one or more other amino acid(s) is conferred.

In case the activity of the *Escherichia coli* K12 protein b3064 or its homologs e.g. a putative O-sialoglycoprotein endopeptidase, with actin-like ATPase domain e.g. as indicated in Table II, columns 5 or 7, line 416, is increased, preferably, in one embodiment the increase of the fine chemical, preferably of glutamine and of one or more other amino acid(s) is conferred.

In case the activity of the *Escherichia coli* K12 protein b3074 or its homologs, e.g. as indicated in Table II, columns 5 or 7, line 417, is increased, e.g. the activity of a tRNA synthetase is increased, preferably, an increase of the respective fine chemical, preferably of glutamate and of one or more other amino acid(s) is conferred.

In case the activity of the *Escherichia coli* K12 protein b3116 or its homologs, e.g. as indicated in Table II, columns 5 or 7, line 418, is increased, e.g. the activity of a L-threonine/L-serine permease, anaerobically inducible (HAAAP family) is increased, preferably, an increase of the respective fine chemical, preferably of glutamate and of one or more other amino acid(s) is conferred.

In case the activity of the *Escherichia coli* K12 protein b3160 or its homologs, e.g. as indicated in Table II, columns 5 or 7, line 419, is increased, e.g. the activity of a monooxygenase with luciferase-like ATPase activity is increased, preferably, an increase of the respective fine chemical, preferably of glutamine and of one or more other amino acid(s) is conferred.

In case the activity of the *Escherichia coli* K12 protein b3166 or its homologs e.g. a tRNA pseudouridine 5S synthase e.g. as indicated in Table II, columns 5 or 7, line 420, is increased, preferably, in one embodiment the increase of the fine chemical, preferably of glutamine and of one or more other amino acid(s) is conferred.

In case the activity of the *Escherichia coli* K12 protein b3169 or its homologs e.g. a transcription termination-antitermination factor e.g. as indicated in Table II, columns 5 or 7, line 421 and 422, is increased, preferably, in one embodiment the increase of the fine chemical, preferably of glutamine and/or of glutamate and of one or more other amino acid(s) is conferred.

In case the activity of the *Escherichia coli* K12 protein b3231 or its homologs e.g. a 50S ribosomal subunit protein L13 e.g. as indicated in Table II, columns 5 or 7, line 423, is increased, preferably, in one embodiment the increase of the fine chemical, preferably of glutamine and of one or more other amino acid(s) is conferred.

In case the activity of the *Escherichia coli* K12 protein b3619 or its homologs e.g. a ADP-L-glycero-D-mannoheptose-6-epimerase, NAD(P)-binding e.g. as indicated in Table II, columns 5 or 7, line 424, is increased, preferably, in one embodiment the increase of the fine chemical, preferably of glutamate and of one or more other amino acid(s) is conferred.

In case the activity of the *Escherichia coli* K12 protein b3644 or its homologs e.g. an uncharacterized stress-induced protein e.g. as indicated in Table II, columns 5 or 7, line 425, is increased, preferably, in one embodiment the increase of the fine chemical, preferably of proline and of one or more other amino acid(s) is conferred.

In case the activity of the *Escherichia coli* K12 protein b3680 or its homologs e.g. an uncharacterized stress-induced protein e.g. as indicated in Table II, columns 5 or 7, line 426, is increased, preferably, in one embodiment the increase of the fine chemical, preferably of glutamine and of one or more other amino acid(s) is conferred.

In case the activity of the *Escherichia coli* K12 protein b3791 or its homologs e.g. an uncharacterized stress-induced protein e.g. as indicated in Table II, columns 5 or 7, line 427 and 428, is increased, preferably, in one embodiment the increase of the fine chemical, preferably of glutamine and/or of glutamate between and of one or more other amino acid(s) is conferred.

In case the activity of the *Escherichia coli* K12 protein b3919 or its homologs e.g. an triosephosphate isomerase e.g. as indicated in Table II, columns 5 or 7, line 429, is increased, preferably, in one embodiment the increase of the fine chemical, preferably of proline and of one or more amino acid(s) is conferred.

In case the activity of the *Escherichia coli* K12 protein b3936 or its homologs e.g. an 50S ribosomal subunit protein L32 e.g. as indicated in Table II, columns 5 or 7, line 430, is increased, preferably, in one embodiment the increase of the fine chemical, preferably of arginine and of one or more other amino acid(s) is conferred.

In case the activity of the *Escherichia coli* K12 protein b4004 or its homologs e.g. a transcriptional regulatory protein e.g. as indicated in Table II, columns 5 or 7, line 431, is increased, preferably, in one embodiment the increase of the fine chemical, preferably of glutamine and of one or more other amino acid(s) is conferred.

In case the activity of the *Escherichia coli* K12 protein b4074 or its homologs e.g. a cytochrome c-type biogenesis protein e.g. as indicated in Table II, columns 5 or 7, line 432, is increased, preferably, in one embodiment the increase of the fine chemical, preferably of glutamine and of one or more other amino acid(s) is conferred.

In case the activity of the *Escherichia coli* K12 protein b4133 or its homologs e.g. a transcriptional activator of pH response (OmpR family) e.g. as indicated in Table II, columns 5 or 7, line 433, is increased, preferably, in one embodiment the increase of the fine chemical, preferably of glutamine and of one or more other amino acid(s) is conferred.

In case the activity of the *Escherichia coli* K12 protein b4346 or its homologs e.g. a component of 5-methylcytosine-specific restriction enzyme McrBC e.g. as indicated in Table II, columns 5 or 7, line 434, is increased, preferably, in one embodiment the increase of the fine chemical, preferably of glutamate and of one or more other amino acid(s) is conferred.

In case the activity of the *Saccharomyces cerevisiae* protein YFL019C or its homologs e.g. a protein as indicated in Table II, columns 5 or 7, line 435, is increased, preferably, in one embodiment the increase of the fine chemical, preferably of glutamate and of one or more other amino acid(s) is conferred. The sequence of YFL019C (Accession number S48324.) from *Saccharomyces cerevisiae* has been published in Murakami et al., Nat. Genet. 10:261-268 (1995) and its activity is not been characterized yet.

Accordingly, in one embodiment, the process of the present invention comprises the use of a gene product with an activity of a YFL019C protein from *Saccharomyces cerevisiae* or its homolog, e.g. as shown herein, for the production of the fine chemical, meaning of glutamate, in particular for increasing the amount of glutamate, preferably glutamate in free or bound form in an organism or a part thereof, as mentioned.

In this context, the respective fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The respective fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the respective fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of arginine chemical preferably has the structure of the polypeptide described herein, in particular of a polypeptides comprising a consensus sequence as indicated in Table IV, columns 7, lines 30 to 37, 390, 405 and/or 430 or of a polypeptide as indicated in Table II, columns 5 or 7, lines 30 to 37, 390, 405 and/or 430 or the functional homologues thereof as described herein, or is encoded by the nucleic acid molecule characterized herein or the nucleic acid molecule according to the invention, for example by a nucleic acid molecule as indicated in Table I, columns 5 or 7, lines 30 to 37, 390, 405 and/or 430 or its herein described functional homologues and has the herein mentioned activity.

A protein having an activity conferring an increase in the amount or level of glutamate preferably has the structure of the polypeptide described herein, in particular of a polypeptides comprising a consensus sequence as indicated in Table IV, column 7, lines 38 to 43, 386, 387, 391, 396, 399 to 401, 403, 406, 413, 414, 417, 418, 421, 424, 427, 434 and/or 435 or of a polypeptide as indicated in Table II, columns 5 or 7, lines 38 to 43, 386, 387, 391, 396, 399 to 401, 403, 406, 413, 414, 417, 418, 421, 424, 427, 434 and/or 435 or the functional homologues thereof as described herein, or is encoded by the nucleic acid molecule characterized herein or the nucleic acid molecule according to the invention, for example by a nucleic acid molecule as indicated in Table I, columns 5 or 7, lines 38 to 43, 386, 387, 391, 396, 399 to 401, 403, 406, 413, 414, 417, 418, 421, 424, 427, 434 and/or 435 or its herein described functional homologues and has the herein mentioned activity.

A protein having an activity conferring an increase in the amount or level of proline preferably has the structure of the polypeptide described herein, in particular of a polypeptides comprising a consensus sequence as indicated in Table IV, column 7, lines 44 to 56, 388, 389, 398, 411, 412, 425 and/or 429 or of a polypeptide as indicated in Table II, columns 5 or 7, lines 44 to 56, 388, 389, 398, 411, 412, 425 and/or 429 or the functional homologues thereof as described herein, or is encoded by the nucleic acid molecule characterized herein or the nucleic acid molecule according to the invention, for example by a nucleic acid molecule as indicated in Table I, columns 5 or 7, lines 44 to 56, 388, 389, 398, 411, 412, 425 and/or 429 or its herein described functional homologues and has the herein mentioned activity.

A protein having an activity conferring an increase in the amount or level of glutamine preferably has the structure of the polypeptide described herein, in particular of a polypeptides comprising a consensus sequence as indicated in Table IV, column 7, lines 57 to 62, 392 to 395, 397, 402, 404, 407 to 410, 415, 416, 419, 420, 422, 423, 426, 428 and/or 431 to 433 or of a polypeptide as indicated in Table II, columns 5 or 7, lines 57 to 62, 392 to 395, 397, 402, 404, 407 to 410, 415, 416, 419, 420, 422, 423, 426, 428 and/or 431 to 433 or the functional homologues thereof as described herein, or is encoded by the nucleic acid molecule characterized herein or the nucleic acid molecule according to the invention, for example by a nucleic acid molecule as indicated in Table I, columns 5 or 7, lines 57 to 62, 392 to 395, 397, 402, 404, 407 to 410, 415, 416, 419, 420, 422, 423, 426, 428 and/or 431 to 433 or its herein described functional homologues and has the herein mentioned activity.

For the purposes of the present invention, the term "arginine" and/or "glutamate" and/or "glutamine" and/or "proline" and "L-arginine" and/or "L-glutamate" and/or "L-glutamine" and/or "L-proline" also encompass the corresponding salts, such as, for example, arginine- and/or glutamate- and/or glutamine- and/or proline-hydrochloride or arginine and/or glutamate and/or glutamine and/or proline sulfate. Preferably the term arginine and/or glutamate and/or glutamine and/or proline is intended to encompass the term L-arginine and/or L-glutamate and/or L-glutamine and/or L-proline.

Owing to the biological activity of the proteins which are used in the process according to the invention and which are encoded by nucleic acid molecules according to the invention, it is possible to produce compositions comprising the respective fine chemical, i.e. an increased amount of the free chemical free or bound, e.g. fine chemical compositions. Depending on the choice of the organism used for the process according to the present invention, for example a microorganism or a plant, compositions or mixtures of various fine chemicals, e.g. comprising further distinct amino acids, fatty acids, vitamins, hormones, sugars, lipids, etc. can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps
a) stabilizing a protein conferring the increased expression of a protein encoded by the nucleic acid molecule of the invention or of the polypeptide of the invention, e.g. of a polypeptide having an activity of a protein as indicated in Table II, column 3, lines 34 to 37, 390, 405 and/or 430 for arginine and/or lines 43, 386, 387, 391, 396, 399 to 401, 403, 406, 413, 414, 417, 418, 421, 424, 427, 434 and/or 435 for glutamate and/or lines 54 to 56, 388, 389, 398, 411, 412, 425 and/or 429 for proline and/or lines 62, 392 to 395, 397, 402, 404, 407 to 410, 415, 416, 419, 420, 422, 423, 426, 428 and/or 431 to 433 for glutamine resp., or its homologs, e.g. as indicated in Table II, columns 5 or 7, lines 34 to 37, 390, 405 and/or 430 for arginine and/or lines 43, 386, 387, 391, 396, 399 to 401, 403, 406, 413, 414, 417, 418, 421, 424, 427, 434 and/or 435 for glutamate and/or lines 54 to 56, 388, 389, 398, 411, 412, 425 and/or 429 for proline and/or lines 62, 392 to 395, 397, 402, 404, 407 to 410, 415, 416, 419, 420, 422, 423, 426, 428 and/or 431 to 433 for glutamine resp., activity having herein-mentioned the respective fine chemical-increasing activity;

b) stabilizing a mRNA conferring the increased expression of a protein encoded by the nucleic acid molecule of the invention, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or of a mRNA encoding the polypeptide of the present invention having herein-mentioned the respective fine chemical-increasing activity;

c) increasing the specific activity of a protein conferring the increased expression of a protein encoded by the nucleic acid molecule of the invention or of the polypeptide of the present invention having herein-mentioned the respective fine chemical-increasing activity, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 respor its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or decreasing the inhibitory regulation of the polypeptide of the invention;

d) generating or increasing the expression of an endogenous or artificial transcription factor mediating the expression of a protein conferring the increased expression of a protein encoded by the nucleic acid molecule of the invention or of the polypeptide of the invention having herein-mentioned the respective fine chemical-increasing activity, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp;

e) stimulating activity of a protein conferring the increased expression of a protein encoded by the nucleic acid molecule of the present invention or a polypeptide of the present invention having herein-mentioned the respective fine chemical-increasing activity, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp, by adding one or more exogenous inducing factors to the organisms or parts thereof;

f) expressing a transgenic gene encoding a protein conferring the increased expression of a polypeptide encoded by the nucleic acid molecule of the present invention or a polypeptide of the present invention, having herein-mentioned the respective fine chemical-increasing activity, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp, and/or g) increasing the copy number of a gene conferring the increased expression of a nucleic acid molecule encoding a polypeptide encoded by the nucleic acid molecule of the invention or the polypeptide of the invention having herein-mentioned the respective fine chemical-increasing activity, e.g. of a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or its homologs, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp, activity.

h) Increasing the expression of the endogenous gene encoding the polypeptide of the invention, e.g. a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434 and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced;

i) Modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead an enhanced the fine chemical production; and/or j) selecting of organisms with especially high activity of the proteins of the invention from natural or from mutagenized resources and breeding them into the target organisms, eg the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring the increase of arginine and/or glutamate and/or proline and/or glutamine after increasing the expression or activity of the encoded polypeptide or having the activity of a polypeptide having an activity of a protein according to Table II, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or its homologs activity, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In general, the amount of mRNA or polypeptide in a cell or a compartment of a organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention or the polypeptide used in the method of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell, or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, a organ, an organelle etc., is achieved by increasing the endogenous level of the polypeptide of the invention or the polypeptide used in the method of the invention. Accordingly, in an embodiment of the present invention, the present invention relates to a process wherein the gene copy number of a gene encoding the polynucleotide or nucleic acid molecule of the invention or the nucleic acid molecule used in the method of the invention as herein described is increased. Further, the endogenous level of the polypeptide of the invention or the polypeptide used in the method of the invention as described can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others citied therein. Reverse genetic strategies to identify insertions (which eventually carrying the activation elements) near in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques:

The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as tilling (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, of the polypeptide of the invention or the polypeptide used in the method of the invention, e.g. conferring the increase of the respective fine chemical after increase of expression or activity can also be increased by introducing a synthetic transcription factor, which binds close to the coding region of an endogenous polypeptide of the invention or the polypeptide used in the method of the invention- or used in the process of the invention or its endogenous homolog-encoding gene and the synthetic transcription factor activates its transcription. A chimeric zinc finger protein can be construed, which comprises a specific DNA-binding domain and an activation domain as e.g. the VP16 domain of Herpes Simplex virus. The specific binding domain can bind to the regulatory region of the endogenous protein coding region. The expression of the chimeric transcription factor in a organism, in particular in a plant, leads to a specific expression of an endogenous polypeptide of the invention or used in the process of the invention, in particular a plant homolog thereof, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It is therefore advantageously to express in an organism a nucleic acid molecule of the invention or the nucleic acid molecule used in the method of the invention or a polypeptide of the invention or the polypeptide used in the method of the invention derived from a evolutionary distantly related organism, as e.g. using a prokaryotic gene in an eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired respective fine chemical(s).

Owing to the introduction of a gene or a plurality of genes conferring the expression of the nucleic acid molecule of the invention or the nucleic acid molecule used in the method of the invention or the polypeptide of the invention or the polypeptide used in the method of the invention as described below, for example the nucleic acid construct mentioned below, into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) respective fine chemicals, in particular amino acids, likewise the fine chemical.

Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids or its precursors, required for the cell's biosynthesis of amino acids may be increased so that the concentration of necessary or relevant precursors, cofactors or intermediates within the cell(s) or within the corresponding storage compartments is increased. Owing to the increased or novel generated activity of the polypeptide of the invention or the polypeptide used in the method of the invention or owing to the increased number of nucleic acid sequences of the invention and/or to the modulation of further genes which are involved in the biosynthesis of the amino acids, e.g. by increasing the activity of enzymes synthesizing precursors or by destroying the activity of one or more genes which are involved in the breakdown of the amino acids, it is possible to increase the yield, production and/or production efficiency of amino acids in the host organism, such as the plants or the microorganisms.

By influencing the metabolism thus, it is possible to produce, in the process according to the invention, further advantageous compounds. Examples of such compounds are, in addition to arginine and/or glutamate and/or glutamine and/or proline Argininosuccinate, Citrulline, Ornithine, Urea, Pyrroline-5-carboxylate, Hydroxy-proline, Hydroxypyrroline-carboxylate, 3-Hydroxypyrroline-5-carboxylate, γ-Glutamylcysteine, Glutathione, Hydroxyglutamate, 4-Hydroxyglutamate, Oxoglutarate, 4-Hydroxy-2-oxoglutarate, Glutamine.

Accordingly, in one embodiment, the process according to the invention relates to a process which comprises:
(a) providing a non-human organism, preferably a microorganism, a non-human animal, a plant or animal cell, a plant or animal tissue or a plant;
(b) increasing an activity of a polypeptide of the invention or a homolog thereof, e.g. as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or of a polypeptide being encoded by the nucleic acid molecule of the present invention and described below, e.g. conferring an increase of the respective fine chemical in an organism, preferably in a microorganism, a non-human animal, a plant or animal cell, a plant or animal tissue or a plant,
(c) growing the organism, preferably the microorganism, the non-human animal, the plant or animal cell, the plant or animal tissue or the plant under conditions which permit the production of the fine chemical in the organism, preferably the microorganism, the plant cell, the plant tissue or the plant; and
(d) if desired, revovering, optionally isolating, the free and/or bound the fine chemical and, optionally further free and/or bound amino acids synthetized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound the respective fine chemical or the free and bound the fine chemical but as option it is also possible to produce, recover and, if desired isolate, other free or/and bound amino acids, in particular lysine. Galili et al., Transgenic Res., 200, 9, 2, 137-144 describes that the heterologous expression of a bacterial gene for the amino acid biosynthesis confers the increase of free as well as of protein-bound amino acids.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the respective fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the respective fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae Tuberculariaceae, Adelotheciaceae, Dinophyceae, Ditrichaceae or Prasinophyceae, or a prokaryotic organism, for example a bacterium or blue alga, in particular a bacterium from the families Actinomycetaceae, Bacillaceae, Brevibacteriaceae, Corynebacteriaceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The microorganisms or the recovered, and if desired isolated, respective fine chemical can then be processed further directly into foodstuffs or animal feeds or for other applications, for example according to the disclosures made in EP-B-0 533 039 or EP-A-0 615 693, which are expressly incorporated herein by reference. The fermentation broth or fermentation products can be purified in the customary manner by extraction and precipitation or via ion exchangers and other methods known to the person skilled in the art and described herein below. Products of these different work-up procedures are amino acids or amino acid compositions which still comprise fermentation broth and cell components in different amounts, advantageously in the range of from 0 to 99% by weight, preferably below 80% by weight, especially preferably between below 50% by weight.

Preferred microorganisms are selected from the group consisting of Chaetomiaceae such as the genera *Chaetomium* e.g. the species *Chaetomidium fimeti*; Choanephoraceae such as the genera *Blakeslea, Choanephora* e.g. the species *Blakeslea trispora, Choanephora cucurbitarum* or *Choanephora infundibulifera* var. *cucurbitarum*; Cryptococcaceae such as the genera *Candida, Crytococcus, Rhodotorula, Torulopsis* e.g. the species *Candida albicans, Candida albomarginata, Candida antarctica, Candida bacarum, Candida bogoriensis, Candida boidinii, Candida bovina, Candida brumptii, Candida cacaoi, Candida cariosilignicola, Candida catenulata, Candida chalmersii, Candida ciferrii, Candida cylindracea, Candida edax, Candida emobii, Candida famata, Candida freyschussii, Candida friedrichii, Candida glabrata, Candida guiffiermondii, Candida haemulonii, Candida humicola, Candida inconspicua, Candida ingens, Candida intermedia, Candida kefyr, Candida krusei, Candida lactiscondensi, Candida lambica, Candida lipolytica, Candida lusitaniae, Candida macedoniensis, Candida magnoliae, Candida membranaefaciens, Candida mesenterica, Candida multigemmis, Candida mycoderma, Candida nemodendra, Candida nitratophila, Candida norvegensis, Candida norvegica, Candida parapsilosis, Candida pelliculosa, Candida peltata, Candida pini, Candida pseudotropicalis, Candida pulcherrima, Candida punicea, Candida pustula, Candida* ravautii, Candida reukaufii, Candida rugosa, Candida sake, Candida silvicola, Candida solani, Candida sp., Candida spandovensis, Candida succiphila, Candida tropicalis, Candida utilis, Candida valida, Candida versatilis, Candida vini, Candida zeylanoides, Cryptococcus albidus, Cryptococcus curvatus, Cryptococcus flavus, Cryptococcus humicola, Cryptococcus hungaricus, Cryptococcus kuetzingii, Cryptococcus laurentii, Cryptococcus macerans, Cryptococcus neoformans, Cryptococcus terreus, Cryptococcus uniguttulatus, Rhodotorula acheniorum, Rhodotorula bacarum, Rhodotorula bogoriensis, Rhodotorula flava, Rhodotorula glutinis, Rhodotorula macerans, Rhodotorula minuta, Rhodotorula mucilaginosa, Rhodotorula pilimanae, Rhodotorula pustula, Rhodotorula rubra, Rhodotorula tokyoensis, Torulopsis cofficulosa, Torulopsis dattila or Torulopsis neoformans; Cunninghamellaceae such as the genera Cunninghamella e.g. the species Cunninghamella blakesleeana, Cunninghamella echinulata, Cunninghamella echinulata var. elegans, Cunninghamella elegans or Cunninghamella homothaffica; Demetiaceae such as the genera Alternaria, Bipolaris, Cercospora, Chalara, Cladosporium, Curvularia, Exophilia, Helicosporium, Helminthosporium, Orbimyces, Philalophora, Pithomyces, Spilocaea, Thielaviopsis, Wangiella e.g. the species Curvularia affinis, Curvularia clavata, Curvularia fallax, Curvularia inaequalis, Curvularia indica, Curvularia lunata, Curvularia pallescens, Curvularia verruculosa or Helminothosporium sp.; Moniliaceae such as the genera Arthrobotrys, Aspergillus, Epidermophyton, Geotrichum, Gliocladium, Histoplasma, Microsporum, Monilia, Oedocephalum, Oidium, Penicillium, Trichoderma, Trichophyton, Thrichoteclum, Verticillium e.g. the species Aspergillus aculeatus, Aspergillus albus, Aspergillus alliaceus, Aspergillus asperescens, Aspergillus awamori, Aspergillus candidus, Aspergillus carbonarius, Aspergillus carneus, Aspergillus chevalieri, Aspergillus chevalieri var. intermedius, Aspergillus clavatus, Aspergillus ficuum, Aspergillus flavipes, Aspergillus flavus, Aspergillus foetidus, Aspergillus fumigatus, Aspergillus giganteus, Aspergillus humicola, Aspergillus intermedius, Aspergillus japonicus, Aspergillus nidulans, Aspergillus niger, Aspergillus niveus, Aspergillus ochraceus, Aspergillus oryzae, Aspergillus ostianus, Aspergillus parasiticus, Aspergillus parasiticus var. globosus, Aspergillus penicillioides, Aspergillus phoenicis, Aspergillus rugulosus, Aspergillus sclerotiorum, Aspergillus sojae var. gymnosardae, Aspergillus sydowi, Aspergillus tamarii, Aspergillus terreus, Aspergillus terricola, Aspergillus toxicarius, Aspergillus unguis, Aspergillus ustus, Aspergillus versicolor, Aspergillus vitricolae, Aspergillus wentii, •Penicillium adametzi, •Penicillium albicans, Penicillium arabicum, Penicillium arenicola, Penicillium argillaceum, Penicillium arvense, Penicillium asperosporum, •Penicillium aurantiogriseum, •Penicillium avellaneum, •Penicillium baarnense, •Penicillium baciffisporum, •Penicillium brasilianum, •Penicillium brevicompactum, •Penicillium camemberti, •Penicillium canadense, •Penicillium canescens, •Penicillium caperatum, •Penicillium capsulatum, •Penicillium caseicolum, •Penicillium chrysogenum, •Penicillium citreonigrum, •Penicillium citrinum, •Penicillium claviforme, •Penicillium commune, •Penicillium corylophilum, •Penicillium corymbiferum, •Penicillium crustosum, •Penicillium cyclopium, •Penicillium daleae, •Penicillium decumbens, •Penicillium dierckxii, •Penicillium digitatum, •Penicillium digitatum var. latum, •Penicillium divaricatum, •Penicillium diversum, •Penicillium duclauxii, •Penicillium echinosporum, •Penicillium expansum, •Penicillium fellutanum, •Penicillium frequentans, •Penicillium funiculosum, •Penicillium glabrum, •Penicillium gladioli, •Penicillium griseofulvum, •Penicillium hirsutum, •Penicillium hispanicum, •Penicillium islandicum, •Penicillium italicum, •Penicillium italicum var. avellaneum, •Penicillium janczewskii, •Penicillium janthinellum, •Penicillium japonicum, •Penicillium lavendulum, •Penicillium lilacinum, •Penicillium lividum, •Penicillium martensii, •Penicillium megasporum, •Penicillium miczynskii, •Penicillium nalgiovense, •Penicillium nigricans, •Penicillium notatum, •Penicillium ochrochloron, •Penicillium odoratum, •Penicillium oxalicum, •Penicillium paraherquei, •Penicillium patulum, •Penicillium pinophilum, •Penicillium piscarium, •Penicillium pseudostromaticum, •Penicillium puberulum, •Penicillium purpurogenum, •Penicillium raciborskii, •Penicillium roqueforti, •Penicillium rotundum, •Penicillium rubrum, •Penicillium sacculum, •Penicillium simplicissimum, Penicillium sp., Penicillium spinulosum, Penicillium steckii, Penicillium stoloniferum, Penicillium striatisporum, Penicillium striatum, Penicillium tardum, Penicillium thomii, Penicillium turbatum, Penicillium variabile, Penicillium vermiculatum, Penicillium vermoesenii, Penicillium verrucosum, Penicillium verrucosum var. corymbiferum, Penicillium verrucosum var. cyclopium, Penicillium verruculosum, Penicillium vinaceum, Penicillium violaceum, Penicillium viridicatum, Penicillium vulpinum, Trichoderma hamatum, Trichoderma harzianum, Trichoderma koningii, Trichoderma longibrachiatum, Trichoderma polysporum, Trichoderma reesei, Trichoderma virens or Trichoderma viride; Mortierellaceae such as the genera Mortierella e.g. the species Mortierella isabeffina, Mortierella polycephala, Mortierella ramanniana, Mortierella vinacea or Mortierella zonata; Mucoraceae such as the genera Actinomucor, Mucor, Phycomyces, Rhizopus, Zygorhynchus e.g. the species Mucor amphibiorum, Mucor circinelloides f. circinelloides, Mucor circinelloides var. griseocyanus, Mucor flavus, Mucor fuscus, Mucor griseocyanus, Mucor heterosporus, Mucor hiemalis, Mucor hiemalis f. hiemalis, Mucor inaequisporus, Mucor indicus, Mucor javanicus, Mucor mucedo, Mucor mucilagineus, Mucor piriformis, Mucor plasmaticus, Mucor plumbeus, Mucor racemosus, Mucor racemosus f. racemosus, Mucor racemosus f. sphaerosporus, Mucor rouxianus, Mucor rouxii, Mucor sinensis, Mucor sp., Mucor spinosus, Mucor tuberculisporus, Mucor variisporus, Mucor variosporus, Mucor wosnessenskii, Phycomyces blakesleeanus, Rhizopus achlamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus var. chinensis, Rhizopus microsporus var. oligosporus, Rhizopus microsporus var. rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici or Rhizopus usamii; Pythiaceae such as the genera Phytium, Phytophthora e.g. the species Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae var. parasitica, Phytophthora palmivora, Phytophthora parasitica or Phytophthora syringae; Sacharomycetaceae such as the genera Hansenula, Pichia, Saccharomyces, Saccharomycodes, Yarrowia e.g. the species Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii, Pichia cellobiosa, Pichia ciferrii, Pichia farinosa, Pichia fermentans, Pichia finlandica, Pichia glucozyma, Pichia guiffiermondii, Pichia haplophila, Pichia henricii, Pichia holstii, Pichia jadinii, Pichia lindnerii, Pichia membranaefaciens, Pichia methanolica, Pichia minuta var. minuta, Pichia minuta var. nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces bailii, Saccharomyces bayanus, Saccharomyces bisporus, Saccharomyces capensis, Saccharomyces carlsbergensis, Saccharomyces cerevisiae, Saccharomyces cerevisiae var. ellipsoideus, Saccharomyces chevalieri, Saccharomyces delbrueckii, Saccharomyces diastaticus, Saccharomyces drosophilarum, Saccharomyces elegans, Saccharomyces ellipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii or Yarrowia lipolytica; Saprolegniaceae such as the genera Saprolegnia e.g. the species Saprolegnia ferax; Schizosacharomycetaceae such as the genera Schizosaccharomyces e.g. the species Schizosaccharomyces japonicus var. japonicus, Schizosaccharomyces japonicus var. versatilis, Schizosaccharomyces malidevorans, Schizosaccharomyces octosporus, Schizosaccharomyces pombe var. malidevorans or Schizosaccharomyces pombe var. pombe; Sodariaceae such as the genera Neurospora, Sordaria e.g. the species Neurospora africana, Neurospora crassa, Neurospora intermedia, Neurospora sitophila, Neurospora tetrasperma, Sordaria fimicola or Sordaria macrospora; Tuberculariaceae such as the genera Epicoccum, Fusarium, Myrothecium, Sphacelia, Starkeyomyces, Tubercularia e.g. the species Fusarium acuminatum, Fusarium anthophilum, Fusarium aquaeductuum, Fusarium aquaeductuum var. medium, Fusarium avenaceum, Fusarium buharicum, Fusarium camptoceras, Fusarium cerealis, Fusarium chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusarium equiseti var. bullatum, Fusarium eumartii, Fusarium flocciferum, Fusarium fujikuroi, Fusarium graminearum, Fusarium graminum, Fusarium heterosporum, Fusarium incamatum, Fusarium inflexum, Fusarium javanicum, Fusarium lateritium, Fusarium lateritium var. majus, Fusarium longipes, Fusarium melanochlorum, Fusarium merismoides, Fusarium merismoides var. chlamydosporale, Fusarium moniliforme, Fusarium moniliforme var. anthophilum, Fusarium moniliforme var. subglutinans, Fusarium nivale, Fusarium nivale var. majus, Fusarium oxysporum, Fusarium oxysporum f. sp. aechmeae, Fusarium oxysporum f. sp. cepae, Fusarium oxysporum f. sp. conglutinans, Fusarium oxysporum f. sp. cucumerinum, Fusarium oxysporum f. sp. cyclaminis, Fusarium oxysporum f. sp. dianthi, Fusarium oxysporum f. sp. lycopersici, Fusarium oxysporum f. sp. melonis, Fusarium oxysporum f. sp. passiflorae, Fusarium oxysporum f. sp. pisi, Fusarium oxysporum f. sp. tracheiphilum, Fusarium oxysporum f. sp. tuberosi, Fusarium oxysporum f. sp. tulipae, Fusarium oxysporum f. sp. vasinfectum, Fusarium pallidoroseum, Fusarium poae, Fusarium proliferatum, Fusarium proliferatum var. minus, Fusarium redolens, Fusarium redolens f. sp. dianthi, Fusarium reticulatum, Fusarium roseum, Fusarium sacchari var. elongatum, Fusarium sambucinum, Fusarium sambucinum var. coeruleum, Fusarium semitectum, Fusarium semitectum var. majus, Fusarium solani, Fusarium solani f. sp. pisi, Fusarium sporotrichioides, Fusarium sporotrichioides var. minus, Fusarium sublunatum, Fusarium succisae, Fusarium sulphureum, Fusarium tabacinum, Fusarium tricinctum, Fusarium udum, Fusarium ventricosum, Fusarium verticifioides, Fusarium xylarioides or Fusarium zonatum; Sporobolomycetaceae such as the genera Bullera, Sporobolomyces, Itersonilia e.g. the species Sporobolomyces holsaticus, Sporobolomyces odorus, Sporobolomyces puniceus, Sporobolomyces salmonicolor, Sporobolomyces singularis or Sporobolomyces tsugae; Adelotheciaceae such as the genera e.g. the species Physcomitrella patens; Dinophyceae such as the genera Crypthecodinium, Phaeodactylum e.g. the species Crypthecodinium cohnii or Phaeodactylum tricornutum; Ditrichaceae such as the genera Ceratodon, Pleuridium, Astomiopsis, Ditrichum, Philibertiella, Ceratodon, Distichium, Skottsbergia e.g. the species Ceratodon antarcticus, Ceratodon purpureus, Ceratodon purpureus ssp. convolutes or Ceratodon purpureus ssp. stenocarpus; Prasinophyceae such as the genera Nephroselmis, Prasinococcus, Scherffelia, Tetraselmis, Mantoniella, Ostreococcus e.g. the species Nephroselmis olivacea, Prasinococcus capsulatus, Scherffelia dubia, Tetraselmis chui, Tetraselmis suecica, Mantoniella squamata or Ostreococcus tauri; Actinomycetaceae such as the genera Actinomyces, Actinobaculum, Arcanobacterium, Mobiluncus e.g. the species Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii subsp. anitratus, Actinomyces neuii subsp. neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii subsp. curtisii, Mobiluncus curtisii subsp. holmesii or Mobiluncus mulieris; Bacillaceae such as the genera Amphibacillus, Anoxybacillus, Bacillus, Exiguobacterium, Gracilibacillus, Holobacillus, Saccharococcus, Salibacillus, Virgibacillus e.g. the species Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius,

*Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borstelensis, Bacillus brevis, Bacillus carboniphilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus* subsp. *fusiformis, Bacillus galactophilus, Bacillus globisporus, Bacillus globisporus* subsp. *marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquariensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis* subsp. *spizizenii, Bacillus subtilis* subsp. *subtilis, Bacillus thermantarcticus, Bacillus thermoaerophilus, Bacillus thermoamylovorans, Bacillus thermoantarcticus, Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetyllcum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus truepefi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii* or *Virgibacillus salexigens*, Brevibacteriaceae such as the genera *Brevibacterium* e.g. the species *Brevibacterium acetylicum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum* or *Brevibacterium vitaeruminis*; Corynebacteriaceae such as the genera *Corynebacterium* e.g. the species *Corynebacterium accolens, Corynebacterium afermentans* subsp. *afermentans, Corynebacterium afermentans* subsp. *lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium Corynebacterium ilicis, Corynebacterium imitans, Corynebacterium insidiosum, Corynebacterium iranicum, Corynebacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacterium michiganense* subsp. *tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis* or *Corynebacterium xerosis*; Enterobacteriacae such as the genera *Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingella, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia* and *Yokenella* e.g.

the species *Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izardii, Buttiauxella noackiae, Buttiauxella warmboldiae, Cedecea davisae, Cedecea lapagei, Cedecea neteri, Citrobacter amalonaticus, Citrobacter diversus, Citrobacter freundii, Citrobacter genomospecies, Citrobacter gillenii, Citrobacter intermedium, Citrobacter koseri, Citrobacter murliniae, Citrobacter sp., Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora* subsp. *atroseptica, Erwinia carotovora* subsp. *betavasculorum, Erwinia carotovora* subsp. *odorifera, Erwinia carotovora* subsp. *wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxylata, Escherichia anindolica, Escherichia aurescens, Escherichia blattae, Escherichia coli, Escherichia coli var. communior, Escherichia coli-mutabile, Escherichia fergusonii, Escherichia hermannii, Escherichia sp., Escherichia vulneris, Ewingella americana, Hafnia alvei, Klebsiella aerogenes, Klebsiella edwardsii* subsp. *atlantae, Klebsiella omithinolytica, Klebsiella oxytoca, Klebsiella planticola, Klebsiella pneumoniae, Klebsiella pneumoniae* subsp. *pneumoniae, Klebsiella* sp., *Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera* sp., *Leclercia adecarboxylata, Leminorella grimontii, Leminorella richardii, Moellerella wisconsensis, Morganella morganii, Morganella morganii* subsp. *morganii, Morganella morganii* subsp. *Obesumbaterium proteus, Pantoea agglomerans, Pantoea ananatis, Pantoea citrea, Pantoea dispersa, Pantoea punctata, Pantoea stewartii* subsp. *stewartii, Pantoea terrea, Pectobacterium atrosepticum, Pectobacterium carotovorum* subsp. *atrosepticum, Pectobacterium carotovorum* subsp. *carotovorum, Pectobacterium chrysanthemi, Pectobacterium cypripedii, Photorhabdus asymbiotica, Photorhabdus luminescens, Photorhabdus luminescens* subsp. *akhurstii, Photorhabdus luminescens* subsp. *laumondii, Photorhabdus luminescens* subsp. *luminescens, Photorhabdus* sp., *Photorhabdus temperata, Plesiomonas shigelloides, Pragia fontium, Proteus hauseri, Proteus ichthyosmius, Proteus inconstans, Proteus mirabilis, Proteus morganii, Proteus myxofaciens, Proteus penneri, Proteus rettgeri, Proteus shigelloides, Proteus vulgaris, Providencia alcalifaciens, Providencia friedericiana, Providencia heimbachae, Providencia rettgeri, Providencia rustigianii, Providencia stuartii, Rahnella aquatilis, Salmonella abony, Salmonella arizonae, Salmonella bongori, Salmonella choleraesuis* subsp. *arizonae, Salmonella choleraesuis* subsp. *bongori, Salmonella choleraesuis* subsp. *cholereasuis, Salmonella choleraesuis* subsp. *diarizonae, Salmonella choleraesuis* subsp. *houtenae, Salmonella choleraesuis* subsp. *indica, Salmonella choleraesuis* subsp. *salamae, Salmonella daressalaam, Salmonella enterica* subsp. *houtenae, Salmonella enterica* subsp. *salamae, Salmonella enteritidis, Salmonella gallinarum, Salmonella heidelberg, Salmonella panama, Salmonella senftenberg, Salmonella typhimurium, Serratia entomophila, Serratia ficaria, Serratia fonticola, Serratia Serratia liquefaciens, Serratia marcescens, Serratia marcescens* subsp. *marcescens, Serratia marinorubra, Serratia odorifera, Serratia plymouthensis, Serratia plymuthica, Serratia proteamaculans, Serratia proteamaculans* subsp. *quinovora, Serratia quinivorans, Serratia rubidaea, Shigella boydii, Shigella flexneri, Shigella paradysenteriae, Shigella sonnet Tatumella ptyseos, Xenorhabdus beddingii, Xenorhabdus bovienii, Xenorhabdus luminescens, Xenorhabdus nematophila, Xenorhabdus nematophila* subsp. *beddingii, Xenorhabdus nematophila* subsp. *bovienii, Xenorhabdus nematophila* subsp. *poinarii* or *Xenorhabdus poinarii*; Gordoniaceae such as the genera *Gordonia, Skermania* e.g. the species *Gordonia aichiensis, Gordonia alkanivorans, Gordonia amarae, Gordonia amicalis, Gordonia bronchialis, Gordonia desulfuricans, Gordonia hirsuta, Gordonia hydrophobica, Gordonia namibiensis, Gordonia nitida, Gordonia paraffinivorans, Gordonia polyisoprenivorans, Gordonia rhizosphera, Gordonia rubripertincta, Gordonia sihwensis, Gordonia sinesedis, Gordonia sputi, Gordonia terrae* or *Gordonia westfalica*; Micrococcaceae such as the genera *Micrococcus, Arthrobacter, Kocuria, Nesterenkonia, Renibacterium, Rothia, Stomatococcus* e.g. the species *Micrococcus agilis, Micrococcus antarcticus, Micrococcus halobius, Micrococcus kristinae, Micrococcus luteus, Micrococcus lylae, Micrococcus nishinomiyaensis, Micrococcus roseus, Micrococcus sedentarius, Micrococcus varians, Arthrobacter agilis, Arthrobacter albus, Arthrobacter atrocyaneus, Arthrobacter aurescens, Arthrobacter chlorophenolicus, Arthrobacter citreus, Arthrobacter creatinolyticus, Arthrobacter crystallopoietes, Arthrobacter cumminsii, Arthrobacter duodecadis, Arthrobacter flavescens, Arthrobacter flavus, Arthrobacter gandavensis, Arthrobacter globiformis, Arthrobacter histidinolovorans, Arthrobacter ilicis, Arthrobacter koreensis, Arthrobacter luteolus, Arthrobacter methylotrophus, Arthrobacter mysorens, Arthrobacter nasiphocae, Arthrobacter nicotianae, Arthrobacter nicotinovorans, Arthrobacter oxydans, Arthrobacter pascens, Arthrobacter picolinophilus, Arthrobacter polychromogenes, Arthrobacter protophormiae, Arthrobacter psychrolactophilus, Arthrobacter radiotolerans, Arthrobacter ramosus, Arthrobacter rhombi, Arthrobacter roseus, Arthrobacter siderocapsulatus, Arthrobacter simplex, Arthrobacter sulfonivorans, Arthrobacter sulfureus, Arthrobacter terregens, Arthrobacter tumescens, Arthrobacter uratoxydans, Arthrobacter ureafaciens, Arthrobacter variabilis, Arthrobacter viscosus, Arthrobacter woluwensis, Kocuria erythromyxa, Kocuria kristinae, Kocuria palustris, Kocuria polaris, Kocuria rhizophila, Kocuria rosea, Kocuria varians, Nesterenkonia halobia, Nesterenkonia lacusekhoensis, Renibacterium salmoninarum, Rothia amarae, Rothia dentocariosa, Rothia mucilaginosa, Rothia nasimurium* or *Stomatococcus mucilaginosus*; Mycobacteriaceae such as the genera *Mycobacterium* e.g. the species *Mycobacterium africanum, Mycobacterium agri, Mycobacterium aichiense, Mycobacterium alvei, Mycobacterium asiaticum, Mycobacterium aurum, Mycobacterium austroafricanum, Mycobacterium bohemicum, Mycobacterium botniense, Mycobacterium brumae, Mycobacterium chelonae* subsp. *abscessus, Mycobacterium chitae, Mycobacterium chlorophenolicum, Mycobacterium chubuense, Mycobacterium confluentis, Mycobacterium cookii, Mycobacterium diernhoferi, Mycobacterium doricum, Mycobacterium duvalii, Mycobacterium fallax, Mycobacterium farcinogenes, Mycobacterium flavescens, Mycobacterium frederiksbergense, Mycobacterium gadium, Mycobacterium gilvum, Mycobacterium gordonae, Mycobacterium hassiacum, Mycobacterium hiberniae, Mycobacterium hodleri, Mycobacterium holsaticum, Mycobacterium komossense, Mycobacterium lacus, Mycobacte-* rium madagascariense, Mycobacterium mageritense, Mycobacterium montefiorense, Mycobacterium moriokaense, Mycobacterium murale, Mycobacterium neoaurum, Mycobacterium nonchromogenicum, Mycobacterium obuense, Mycobacterium palustre, Mycobacterium parafortuitum, Mycobacterium peregrinum, Mycobacterium phlei, Mycobacterium pinnipedii, Mycobacterium poriferae, Mycobacterium pulveris, Mycobacterium rhodesiae, Mycobacterium shottsii, Mycobacterium sphagni, Mycobacterium terrae, Mycobacterium thermoresistibile, Mycobacterium tokaiense, Mycobacterium triviale, Mycobacterium tusciae or Mycobacterium vanbaalenii; Nocardiaceae such as the genera Nocardia, Rhodococcus e.g. the species Nocardia abscessus, Nocardia africana, Nocardia amarae, Nocardia asteroides, Nocardia autotrophica, Nocardia beijingensis, Nocardia brasiliensis, Nocardia brevicatena, Nocardia caishijiensis, Nocardia calcarea, Nocardia carnea, Nocardia cellulans, Nocardia cerradoensis, Nocardia coeliaca, Nocardia corynebacterioides, Nocardia crassostreae, Nocardia cummidelens, Nocardia cyriacigeorgica, Nocardia farcinica, Nocardia flavorosea, Nocardia fluminea, Nocardia globerula, Nocardia hydrocarbonoxydans, Nocardia ignorata, Nocardia mediterranei, Nocardia nova, Nocardia orientalis, Nocardia otitidis-caviarum, Nocardia otitidiscaviarum, Nocardia paucivorans, Nocardia petroleophila, Nocardia pinensis, Nocardia pseudobrasiliensis, Nocardia pseudovaccinii, Nocardia puris, Nocardia restricta, Nocardia rugosa, Nocardia salmonicida, Nocardia saturnea, Nocardia seriolae, Nocardia soli, Nocardia sulphurea, Nocardia transvalensis, Nocardia uniformis, Nocardia vaccinii, Nocardia veterana or Nocardia vinacea; Pseudomonaceae such as the genera Azomonas, Azotobacter, Cellvibrio, Chryseomonas, Flaviomonas, Lampropedia, Mesophilobacter, Morococcus, Oligella, Pseudomonas, Rhizobacter, Rugamonas, Serpens, Thermoleophilum, Xylophilus e.g. the species Azomonas agilis, Azomonas insignis, Azomonas macrocytogenes, Azotobacter agilis, Azotobacter agilis subsp. armeniae, Azotobacter armeniacus, Azotobacter beijerinckii, Azotobacter chroococcum, Azotobacter indicum, Azotobacter macrocytogenes, Azotobacter miscellum, Azotobacter nigricans subsp. nigricans, Azotobacter paspali, Azotobacter salinestris, Azotobacter sp., Azotobacter vinelandii, Flavimonas oryzihabitans, Mesophilobacter marinus, Oligella urethralis, Pseudomonas acidovorans, Pseudomonas aeruginosa, Pseudomonas agarici, Pseudomonas alcaligenes, Pseudomonas aminovorans, Pseudomonas amygdali, Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocoffigans, Pseudomonas balearica, Pseudomonas barkeri, Pseudomonas bathycetes, Pseudomonas beijerinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chloritidismutans, Pseudomonas ch/ororaphis, Pseudomonas cichorii, Pseudomonas citronellois, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes subsp. konjaci, Pseudomonas pseudoalcaligenes subsp. pseudoalcaligenes, Pseudomonas pseudoflava, Pseudomonas putida, Pseudomonas putida var. naraensis, Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbicans, Pseudomonas ruhlandii, Pseudomonas saccharophila, Pseudomonas savastanoi, Pseudomonas savastanoi pvar. glycinea, Pseudomonas savastanoi pvar. phaseolicola, Pseudomonas solanacearum, Pseudomonas sp., Pseudomonas spinosa, Pseudomonas stanieri, Pseudomonas stutzeri, Pseudomonas syringae, Pseudomonas syringae pvar. aptata, Pseudomonas syringae pvar. atrofaciens, Pseudomonas syringae pvar. coronafaciens, Pseudomonas syringae pvar. delphinii, Pseudomonas syringae pvar. glycinea, Pseudomonas syringae pvar. helianthi, Pseudomonas syringae pvar. lachrymans, Pseudomonas syringae pvar. lapsa, Pseudomonas syringae pvar. morsprunorum, Pseudomonas syringae pvar. phaseolicola, Pseudomonas syringae pvar. primulae, Pseudomonas syringae pvar. syringae, Pseudomonas syringae pvar. tabaci, Pseudomonas syringae pvar. tomato, Pseudomonas syringae subsp. glycinea, Pseudomonas syringae subsp. savastanoi, Pseudomonas syringae subsp. syringae, Pseudomonas syzygii, Pseudomonas tabaci, Pseudomonas taeniospiralis, Pseudomonas testosterone, Pseudomonas thermocarboxydovorans, Pseudomonas thermotolerans, Pseudomonas thivervalensis, Pseudomonas tomato, Pseudomonas trivialis, Pseudomonas veronii, Pseudomonas vesicularis, Pseudomonas viridiflava, Pseudomonas viscogena, Pseudomonas woodsii, Rhizobacter dauci, Rhizobacter daucus or Xylophilus ampelinus; Rhizobiaceae such as the genera Agrobacterium, Carbophilus, Chelatobacter, Ensifer, Rhizobium, Sinorhizobium e.g. the species Agrobacterium atlanticum, Agrobacterium ferrugineum, Agrobacterium gelatinovorum, Agrobacterium larrymoorei, Agrobacterium meteori, Agrobacterium radiobacter, Agrobacterium rhizogenes, Agrobacterium rubi, Agrobacterium stellulatum,

*Agrobacterium tumefaciens, Agrobacterium vitis, Carbophilus carboxidus, Chelatobacter heintzii, Ensifer adhaerens, Ensifer arboris, Ensifer fredii, Ensifer kostiensis, Ensifer kummerowiae, Ensifer medicae, Ensifer meliloti, Ensifer saheli, Ensifer terangae, Ensifer xinjiangensis, Rhizobium ciceri Rhizobium etli, Rhizobium fredii, Rhizobium galegae, Rhizobium gallicum, Rhizobium giardinii, Rhizobium hainanense, Rhizobium huakuii, Rhizobium huautlense, Rhizobium indigoferae, Rhizobium japonicum, Rhizobium leguminosarum, Rhizobium loessense, Rhizobium loti, Rhizobium lupini, Rhizobium mediterraneum, Rhizobium meliloti, Rhizobium mongolense, Rhizobium phaseoli, Rhizobium radiobacter, Rhizobium rhizogenes, Rhizobium rubi, Rhizobium sullae, Rhizobium tianshanense, Rhizobium trifoffi, Rhizobium tropici, Rhizobium undicola, Rhizobium vitis, Sinorhizobium adhaerens, Sinorhizobium arboris, Sinorhizobium fredii, Sinorhizobium kostiense, Sinorhizobium kummerowiae, Sinorhizobium medicae, Sinorhizobium meliloti, Sinorhizobium morelense, Sinorhizobium saheli* or *Sinorhizobium xinjiangense*; Streptomycetaceae such as the genera *Kitasatosprora, Streptomyces, Streptoverticillium* e.g. the species *Streptomyces abikoensis, Streptomyces aburaviensis, Streptomyces achromogenes* subsp. *achromogenes, Streptomyces achromogenes* subsp. *rubradiris, Streptomyces acidiscabies, Streptomyces acrimycini, Streptomyces aculeolatus, Streptomyces afghaniensis, Streptomyces alanosinicus, Streptomyces albaduncus, Streptomyces albiaxialis, Streptomyces albidochromogenes, Streptomyces albidoflavus, Streptomyces albireticuli, Streptomyces albofaciens, Streptomyces alboflavus, Streptomyces albogriseolus, Streptomyces albolongus, Streptomyces alboniger, Streptomyces albospinus, Streptomyces albosporeus* subsp. *albosporeus, Streptomyces albosporeus* subsp. *labilomyceticus, Streptomyces alboverticillatus, Streptomyces albovinaceus, Streptomyces alboviridis, Streptomyces albulus, Streptomyces albus* subsp. *albus, Streptomyces albus* subsp. *pathocidicus, Streptomyces almquistii, Streptomyces althioticus, Streptomyces amakusaensis, Streptomyces ambofaciens, Streptomyces aminophilus, Streptomyces anandii, Streptomyces anthocyanicus, Streptomyces antibioticus, Streptomyces antimycoticus, Streptomyces anulatus, Streptomyces arabicus, Streptomyces ardus, Streptomyces arenae, Streptomyces argenteolus, Streptomyces armeniacus, Streptomyces asiaticus, Streptomyces asterosporus, Streptomyces atratus, Streptomyces atroaurantiacus, Streptomyces atroolivaceus, Streptomyces atrovirens, Streptomyces aurantiacus, Streptomyces aurantiogriseus, Streptomyces aureocirculatus, Streptomyces aureofaciens, Streptomyces aureorectus, Streptomyces aureoversilis, Streptomyces aureoverticillatus, Streptomyces aureus, Streptomyces avellaneus, Streptomyces avermectinius, Streptomyces avermitilis, Streptomyces avidinii, Streptomyces azaticus, Streptomyces azureus, Streptomyces baarnensis, Streptomyces bacillaris, Streptomyces badius, Streptomyces baldaccii, Streptomyces bambergiensis, Streptomyces beijiangensis, Streptomyces bellus, Streptomyces bikiniensis, Streptomyces biverticillatus, Streptomyces blastmyceticus, Streptomyces bluensis, Streptomyces bobili, Streptomyces bottropensis, Streptomyces brasiliensis, Streptomyces bungoensis, Streptomyces cacaoi* subsp. *asoensis, Streptomyces cacaoi* subsp. *cacaoi, Streptomyces caelestis, Streptomyces caeruleus, Streptomyces californicus, Streptomyces calvus, Streptomyces canaries, Streptomyces candidus, Streptomyces canescens, Streptomyces cangkringensis, Streptomyces caniferus, Streptomyces canus, Streptomyces capillispiralis, Streptomyces capoamus, Streptomyces carpaticus, Streptomyces carpinensis, Streptomyces catenulae, Streptomyces caviscabies, Streptomyces cavourensis* subsp. *cavourensis, Streptomyces cavourensis* subsp. *washingtonensis, Streptomyces cellostaticus, Streptomyces celluloflavus, Streptomyces cellulolyticus, Streptomyces cellulosae, Streptomyces champavatii, Streptomyces chartreuses, Streptomyces chattanoogensis, Streptomyces chibaensis, Streptomyces chrestomyceticus, Streptomyces chromofuscus, Streptomyces chryseus, Streptomyces chrysomallus* subsp. *chrysomallus, Streptomyces chrysomallus* subsp. *fumigatus, Streptomyces cinereorectus, Streptomyces cinereoruber* subsp. *cinereoruber, Streptomyces cinereoruber* subsp. *fructofermentans, Streptomyces cinereospinus, Streptomyces cinereus, Streptomyces cinerochromogenes, Streptomyces cinnabarinus, Streptomyces cinnamonensis, Streptomyces cinnamoneus, Streptomyces cinnamoneus* subsp. *albosporus, Streptomyces cinnamoneus* subsp. *cinnamoneus, Streptomyces cinnamoneus* subsp. *lanosus, Streptomyces cinnamoneus* subsp. *sparsus, Streptomyces cirratus, Streptomyces ciscaucasicus, Streptomyces citreofluorescens, Streptomyces clavifer, Streptomyces clavuligerus, Streptomyces cochleatus, Streptomyces coelescens, Streptomyces coelicoflavus, Streptomyces coelicolor, Streptomyces coeruleoflavus, Streptomyces coeruleofuscus, Streptomyces coeruleoprunus, Streptomyces coeruleorubidus, Streptomyces coerulescens, Streptomyces collinus, Streptomyces colombiensis, Streptomyces corchorusii, Streptomyces costaricanus, Streptomyces cremeus, Streptomyces crystallinus, Streptomyces curacoi, Streptomyces cuspidosporus, Streptomyces cyaneofuscatus, Streptomyces cyaneus, Streptomyces cyanoalbus, Streptomyces cystargineus, Streptomyces daghestanicus, Streptomyces diastaticus* subsp. *ardesiacus, Streptomyces diastaticus* subsp. *diastaticus, Streptomyces diastatochromogenes, Streptomyces distallicus, Streptomyces djakartensis, Streptomyces durhamensis, Streptomyces echinatus, Streptomyces echinoruber, Streptomyces ederensis, Streptomyces ehimensis, Streptomyces endus, Streptomyces enissocaesilis, Streptomyces erumpens, Streptomyces erythraeus, Streptomyces erythrogriseus, Streptomyces eurocidicus, Streptomyces europaeiscabiei, Streptomyces eurythermus, Streptomyces exfoliates, Streptomyces felleus, Streptomyces fervens, Streptomyces fervens* subsp. *fervens, Streptomyces fervens* subsp. *melrosporus, Streptomyces filamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flaviscleroticus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatiscleroticus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces Streptomyces glaucescens, Streptomyces glaucosporus, Streptomyces glaucus, Streptomyces globisporus* subsp. *caucasicus, Streptomyces globisporus* subsp. *flavofuscus, Streptomyces globisporus* subsp. *globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocarneus, Streptomyces griseochromogenes, Streptomyces griseoflavus, Streptomyces griseofuscus, Streptomyces griseoincarna-* tus, *Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces griseoverticillatus, Streptomyces griseoviridis, Streptomyces griseus* subsp. *alpha, Streptomyces griseus* subsp. *cretosus, Streptomyces griseus* subsp. *griseus, Streptomyces griseus* subsp. *solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus* subsp. *angustmyceticus, Streptomyces hygroscopicus* subsp. *decoyicus, Streptomyces hygroscopicus* subsp. *glebosus, Streptomyces hygroscopicus* subsp. *hygroscopicus, Streptomyces hygroscopicus* subsp. *ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae* subsp. *grasserius, Streptomyces lavendulae* subsp. *lavendulae, Streptomyces lavenduligriseus, Streptomyces lavendulocolor, Streptomyces levis, Streptomyces libani* subsp. *libani, Streptomyces libani* subsp. *rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces matensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporeus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli* subsp. *cellulophilus, Streptomyces olivoreticuli* subsp. *olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramulosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus* subsp. *paromomycinus, Streptomyces rimosus* subsp. *rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, Streptomyces rubiginosohelvolus, Streptomyces rubiginosus, Streptomyces rubrogriseus, Streptomyces rutgersensis* subsp. *castelarensis, Streptomyces rutgersensis* subsp. *rutgersensis, Streptomyces salmonis, Streptomyces sampsonii, Streptomyces sanglieri, Streptomyces sannanensis, Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces the rmodiastaticus, Streptomyces thermogriseus, Streptomyces thermolineatus, Streptomyces thermonitrificans, Streptomyces thermospinosisporus, Streptomyces thermoviolaceus* subsp. *apingens, Streptomyces thermoviolaceus* subsp. *thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vina-* ceus, *Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticillium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium blastmyceticum, Streptoverticillium cinnamoneum* subsp. *albosporum, Streptomyces cinnamoneus* subsp. *albosporus, Streptoverticillium cinnamoneum* subsp. *cinnamoneum, Streptoverticillium cinnamoneum* subsp. *lanosum, Streptoverticillium cinnamoneum* subsp. *sparsum, Streptoverticillium distallicum, Streptoverticillium ehimense, Streptoverticillium eurocidicum, Streptoverticillium fervens* subsp. *fervens, Streptoverticillium fervens* subsp. *melrosporus, Streptoverticillium flavopersicum, Streptoverticillium griseocameum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli* subsp. *cellulophilum, Streptoverticillium olivoreticuli* subsp. *olivoreticuli, Streptoverticillium olivoreticulum, Streptoverticillium olivoreticulum* subsp. *cellulophilum, Streptoverticillium olivoverticillatum, Streptoverticillium orinoci, Streptoverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptoverticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum.*

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus sp., Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium sp., Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida boidinii, Candida bombicola, Candida cylindracea, Candida parapsilosis, Candida rugosa, Candida tropicalis, Pichia methanolica* and *Pichia pastoris.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucurbita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Jan-* ipha manihot, Jatropha manihot., Manihot aipil, Manihot dulcis, Manihot manihot, Manihot melanobasis, Manihot esculenta [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocoas* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans macrocarpa, Juglans nigra* or *Wallia nigra* [walnut, black walnut, common walnut, persian walnut, white walnut, butternut, black walnut]; Lauraceae such as the genera *Persea, Laurus* e.g. the species *laurel Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elaeis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon., Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticiffiflorum, Sorghum vulgare, Holcus halepensis, Sorghum miliaceum millet, Panicum militaceum [Sorghum, millet], Oryza sativa, Oryza latifolia* [rice], *Zea mays* [corn, maize] *Triticum aestivum, Triticum durum, Triticum turgidum, Triticum hybemum, Triticum macha, Triticum sativum* or *Triticum vulgare* [wheat, bread wheat, common wheat], Proteaceae such as the genera *Macadamia* e.g. the species *Macadamia intergrifolia [macadamia]*; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao [cacao]*; Theaceae such as the genera *Camellia* e.g. the species *Camellia sinensis*) [tea].

All abovementioned organisms can in principle also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana.* Fabaceae such as the genera *Glycine* e.g. the species *Glycine max, Soja hispida* or *Soja max* [soybean] (wobei ich nicht sicher bin, ob es Soja max überhaupt gibt, die heißt eigentlich *Glycine max*). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor [Sorghum, millet], Oryza sativa, Oryza latifolia* [rice], *Zea mays* [corn, maize] *Triticum aestivum, Triticum durum, Triticum*

*turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum, Lycopersicon pyriforme, Solanum integrifolium* or *Solanum lycopersicum* [tomato].

All abovementioned organisms can in principle also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or a derivative thereof, or b) a genetic regulatory element, for example a promoter, which is functionally linked to the nucleic acid sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The respective fine chemical, which is synthesized in the organism, in particular the microorganism, the cell, the tissue or the plant, of the invention can be isolated if desired. Depending on the use of the respective fine chemical, different purities resulting from the purification may be advantageous as will be described herein below.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine.

In one embodiment, after an activity of a polypeptide of the present invention or used in the process of the present invention has been increased or generated, or after the expression of a nucleic acid molecule or polypeptide according to the invention has been generated or increased, the transgenic plant generated can be grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure respective fine chemical or chemically pure compositions comprising the respective fine chemical may also be produced by the process described above. To this end, the respective fine chemical or the compositions are isolated in the known manner from an organism according to the invention, such as the microorganisms, non-human animal or the plants, and/or their culture medium in which or on which the organisms had been grown. These chemically pure respective fine chemical or said compositions are advantageous for applications in the field of the food industry, the cosmetics industry or the pharmaceutical industry.

Thus, the content of plant components and preferably also further impurities is as low as possible, and the abovementioned respective fine chemical is obtained in as pure form as possible. In these applications, the content of plant components advantageously amounts to less than 10%, preferably 1%, more preferably 0.1%, very especially preferably 0.01% or less.

Accordingly, the respective fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the respective fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found a tissue, more preferred in an organism or in a harvestable part thereof.

In principle, the respective fine chemicals produced can be increased in two ways by the process according to the invention. The pool of free respective fine chemicals, in particular of the free respective fine chemical, and/or the content of protein-bound respective fine chemicals, in particular of the protein-bound respective fine chemical may advantageously be increased.

It may be advantageous to increase the pool of free amino acids in the transgenic organisms by the process according to the invention in order to isolate high amounts of the pure respective fine chemical.

In another preferred embodiment of the invention a combination of the increased expression of the nucleic acid sequence or the protein of the invention together with the transformation of a protein or polypeptid, which functions as a sink for the desired amino acid for example methionine, lysine or threonine in the organism is useful to increase the production of the respective fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670,635). Galili et al., Transgenic Res. 2000 showed, that enhancing the synthesis of threonine by a feed back insensitive aspartate kinase did not lead only to in increase in free threonine but also in protein bound threonine.

In may also be advantageous to increase the content of the protein-bound respective fine chemical.

In a preferred embodiment, the fine chemical (arginine and/or glutamate and/or glutamine and/or proline) is produced in accordance with the invention and, if desired, is isolated. The production of further amino acids such as methionine, lysine and/or threonine mixtures of amino acid by the process according to the invention is advantageous.

In the case of the fermentation of microorganisms, the abovementioned amino acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamide resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acid. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews MJ, 1997 (Lysine, threonine and methionine biosynthesis. In BK Singh, ed, Plant Amino Acids: Biochemistry and Biotechnology. Dekker, New York, pp 205-225; H Hesse and R Hoefgen. (2003) Molecular aspects of methionine biosynthesis. TIPS 8(259-262.

In a preferred embodiment, the present invention relates to a process for the production of the fine chemical comprising or generating in an organism or a part thereof the expression of at least one nucleic acid molecule comprising a nucleic acid molecule selected from the group consisting of:

a) nucleic acid molecule encoding, preferably at least the mature form, of the polypeptide having a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or a fragment thereof, which confers an increase in the amount of the respective fine chemical in an organism or a part thereof;

b) nucleic acid molecule comprising, preferably at least the mature form, of a nucleic acid molecule having a sequence as indicated in Table I, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybridizes with a nucleic acid molecule of (a) to (c) under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers pairs having a sequence as indicated in Table 111, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. and conferring an increase in the amount of the respective fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the fine chemical in an organism or a part thereof;

j) nucleic acid molecule which encodes a polypeptide comprising the consensus sequence having a sequences as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of the respective fine chemical in an organism or a part thereof;

k) nucleic acid molecule comprising one or more of the nucleic acid molecule encoding the amino acid sequence of a polypeptide encoding a domain of the polypeptide indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. and conferring an increase in the amount of the respective fine chemical in an organism or a part thereof; and l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the fine chemical in an organism or a part thereof;

or which comprises a sequence which is complementary thereto.

In one embodiment, the nucleic acid molecule used in the process of the invention distinguishes over the sequence indicated in Table IA, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more nucleotides. In one embodiment, the nucleic acid molecule used in the process of the invention does not consist of the sequence shown in indicated in Table IA, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule used in the process of the invention is less than 100%, 99.999%, 99.99%, 99.9% or 99% identical to a sequence indicated in Table IA, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, the nucleic acid molecule does not encode a polypeptide of a sequence indicated in Table II A, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, the nucleic acid molecule used in the process of the invention distinguishes over the sequence indicated in Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more nucleotides. In one embodiment, the nucleic acid molecule used in the process of the invention does not consist of the sequence shown in indicated in Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule used in the process of the invention is less than 100%, 99.999%, 99.99%, 99.9% or 99% identical to a sequence indicated in Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, the nucleic acid molecule does not encode a polypeptide of a sequence indicated in Table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, the nucleic acid molecule used in the process distinguishes over the sequence indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more nucleotides. In one embodiment, the nucleic acid molecule used in the process of the invention does not consist of the sequence indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule of the present invention is less than 100%, 99.999%, 99.99%, 99.9% or 99% identical to the sequence indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, the nucleic acid molecule does not encode a polypeptide of a sequence indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, The terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., nucleic acid molecules which are derived from a amino acid sequences as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or from polypeptides comprising the consensus sequence as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or their derivatives or homologues encoding polypeptides with the enzymatic or biological activity of a polypeptide as indicated in Table I, column 3, 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or e.g. conferring a increase of the fine chemical after increasing its expression or activity are advantageously increased in the process according to the invention.

In one embodiment, said sequences are cloned into nucleic acid constructs, either individually or in combination. These nucleic acid constructs enable an optimal synthesis of the respective fine chemical produced in the process according to the invention.

Nucleic acid molecules, which are advantageous for the process according to the invention and which encode polypeptides with an activity of a polypeptide of the invention or the polypeptide used in the method of the invention or used in the process of the invention, e.g. of a protein as indicated in Table II, column 5, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 respor being encoded by a nucleic acid molecule indicated in Table I, column 5, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or of its homologs, e.g. as indicated in Table II, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Chemy J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with protein activity of proteins as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring a arginine and/or glutamate and/or proline and/or glutamine increase.

The nucleic acid sequence(s) used in the process for the production of the respective fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the respective fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the respective fine chemical produced in the process according to the invention. This improved production, or production efficiency, of the respective fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus columa, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliose, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatas, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa spp., Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum or Triticum vulgare, Cofea spp., Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum., Lycopersicon pyriforme, Solanum integrifolium, Solanum lycopersicum Theobroma cacao* or *Camellia sinensis.*

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species

*Saccharomyces cerevisiae* for the production of the respective fine chemical in microorganism.

The skilled worker knows other suitable sources for the production of respective fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*.

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium bacterium melassecola, Corynebacterium* sp. or *Escherichia coli*, specifically *Escherichia coli* K12 and its described strains.

However, it is also possible to use artificial sequences, which differ in one or more bases from the nucleic acid sequences found in organisms, or in one or more amino acid molecules from polypeptide sequences found in organisms, in particular from the polypeptide sequences indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or the functional homologues thereof as described herein, preferably conferring above-mentioned activity, i.e. conferring a increase of the respective fine chemical after increasing its activity.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as the pairs indicated in Table III, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. by means of polymerase chain reaction can be generated on the basis of a sequence shown herein, for example the sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or the sequences derived from a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved region for the polypeptide of the invention are indicated in the alignments shown in the figures. Conserved regions are those, which show a very little variation in the amino acid in one particular position of several homologs from different origin. The consenus sequence indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. is derived from said aligments.

Degenerated primers can then be utilized by PCR for the amplification of fragments of novel proteins having abovementioned activity, e.g. conferring the increase of the respective fine chemical after increasing its expression or activity or further functional homologs of the polypeptide of the invention or the polypeptide used in the method of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hydridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown herein below:
(1) Hybridization conditions can be selected, for example, from the following conditions:
a) 4×SSC at 65° C.,
b) 6×SSC at 45° C.,
c) 6×SSC, 100 mg/ml denatured fragmented fish sperm DNA at 68° C.,
d) 6×SSC, 0.5% SDS, 100 mg/ml denatured salmon sperm DNA at 68° C.,
e) 6×SSC, 0.5% SDS, 100 mg/ml denatured fragmented salmon sperm DNA, 50% formamide at 42° C.,
f) 50% formamide, 4×SSC at 42° C.,
g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
h) 2× or 4×SSC at 50° C. (low-stringency condition), or
i) 30 to 40% formamide, 2× or 4×SSC at 42° C. (low-stringency condition).
(2) Wash steps can be selected, for example, from the following conditions:
a) 0.015 M NaCl/0.0015 M sodium citrate/0.1% SDS at 50° C.
b) 0.1×SSC at 65° C.
c) 0.1×SSC, 0.5% SDS at 68° C.
d) 0.1×SSC, 0.5% SDS, 50% formamide at 42° C.
e) 0.2×SSC, 0.1% SDS at 42° C.
f) 2×SSC at 65° C. (low-stringency condition).

Polypeptides having above-mentioned activity, i.e. conferring the increase of the respective fine chemical level, derived from other organisms, can be encoded by other DNA sequences which hybridize to a sequences indicated in Table I, columns 5 or 7, preferably table I B, lines 34 to 37, 390, 405 and/or 430 for arginine
and/or lines 43, 386, 387, 391, 396, 399 to 401, 403, 406, 413, 414, 417, 418, 421, 424, 427, 434, and/or 435 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine resp.,
under relaxed hybridization conditions and which code on expression for peptides having the respective fine chemical, in particular, of arginine and/or glutamate and/or proline and/or glutamine, resp., increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the respective fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridising with the nucleic acid molecule of the invention or the nucleic acid molecule used in the method of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the respective fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., is one which is sufficiently complementary to one of said nucleotide sequences such that it can hybridize to one of said nucleotide sequences, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence indicated in Table I, columns 5 or 7, preferably table I B, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably table I B or a portion thereof and preferably has above mentioned activity, in particular, of arginine and/or glutamate and/or proline and/or glutamine increasing activity after increasing the activity or an activity of a product of a gene encoding said sequences or their homologs.

The nucleic acid molecule of the invention or the nucleic acid molecule used in the method of the invention comprises a nucleotide sequence which hybridizes, preferably hybridizes under stringent conditions as defined herein, to one of the nucleotide sequences indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or a portion thereof and encodes a protein having above-mentioned activity and as indicated in indicated in Table II.

Optionally, the nucleotide sequence, which hybridises to one of the nucleotide sequences indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. has further one or more of the activities annotated or known for the a protein as indicated in Table II, column 3, lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Moreover, the nucleic acid molecule of the invention can comprise only a portion of the coding region of one of the sequences indicated in Table I, columns 5 or 7, preferably table I B, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. for example a fragment which can be used as a probe or primer or a fragment encoding a biologically active portion of the polypeptide of the present invention or of a polypeptide used in the process of the present invention, i.e. having above-mentioned activity, e.g. conferring an increase of arginine and/or glutamate and/or proline and/or glutamine, resp., if its activity is increased. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. an anti-sense sequence of one of the sequences, e.g., as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primer pairs indicated in Table III, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., will result in a fragment of a polynucleotide sequence as indicated in Table I, columns 5 or 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or its gene product Primer sets are interchangeable. The person skilled in the art knows to combine said primers to result in the desired product, e.g. in a full-length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention encodes a polypeptide or portion thereof which includes an amino acid sequence which is sufficiently homologous to an amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., such that the protein or portion thereof maintains the ability to participate in the respective fine chemical production, in particular an activity increasing the level of arginine and/or glutamate and/or proline and/or glutamine, resp., as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., such that the protein or portion thereof is able to participate in the increase of the respective fine chemical production. In one embodiment, a protein or portion thereof as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., has for example an activity of a polypeptide as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and has above-mentioned activity, e.g. conferring preferably the increase of the respective fine chemical.

Portions of proteins encoded by the nucleic acid molecule of the invention or the nucleic acid molecule used in the method of the invention are preferably biologically active, preferably having above-mentioned annotated activity, e.g. conferring a increase the respective fine chemical after increase of activity.

As mentioned herein, the term "biologically active portion" is intended to include a portion, e.g., a domain/motif, that confers increase of the respective fine chemical or has an immunological activity such that it is binds to an antibody binding specifically to the polypeptide of the present invention or a polypeptide used in the process of the present invention for producing the respective fine chemical;

The invention further relates to nucleic acid molecules that differ from one of the nucleotide sequences indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. (and portions thereof) due to degeneracy of the genetic code and thus encode a polypeptide of the present invention, in particular a polypeptide having above mentioned activity, e.g. conferring an increase in the respective fine chemical in a organism, e.g. as that polypeptides comprising the consensus sequences as indicated in Table IV, column 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or of the polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or their functional homologues. Advantageously, the nucleic acid molecule of the invention or the nucleic acid molecule used in the method of the invention comprises, or in an other embodiment has, a nucleotide sequence encoding a protein comprising, or in an other embodiment having, a consensus sequences as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or of the polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or the functional homologues. In a still further embodiment, the nucleic acid molecule of the invention or the nucleic acid molecule used in the method of the invention encodes a full length protein which is substantially homologous to an amino acid sequence comprising a consensus sequence as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. or the functional homologues thereof. However, in a preferred embodiment, the nucleic acid molecule of the present invention does not consist of a sequence as indicated in Table I, columns 5 or 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably as indicated in Table I A, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Preferably the nucleic acid molecule of the invention is a functional homologue or identical to a nucleic acid molecule indicated in Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In addition, it will be appreciated by those skilled in the art that DNA sequence polymorphisms that lead to changes in the amino acid sequences may exist within a population. Such genetic polymorphism in the gene encoding the polypeptide of the invention or the polypeptide used in the method of the invention or comprising the nucleic acid molecule of the invention or the nucleic acid molecule used in the method of the invention may exist among individuals within a population due to natural variation.

As used herein, the terms "gene" and "recombinant gene" refer to nucleic acid molecules comprising an open reading frame encoding the polypeptide of the invention or the polypeptide used in the method of the invention or comprising the nucleic acid molecule of the invention or the nucleic acid molecule used in the method of the invention or encoding the polypeptide used in the process of the present invention, preferably from a crop plant or from a microorganism useful for the production of respective fine chemicals, in particular for the production of the respective fine chemical. Such natural variations can typically result in 1-5% variance in the nucleotide sequence of the gene. Any and all such nucleotide variations and resulting amino acid polymorphisms in genes encoding a polypeptide of the invention or the polypeptide used in the method of the invention or comprising a the nucleic acid molecule of the invention or the nucleic acid molecule used in the method of the invention that are the result of natural variation and that do not alter the functional activity as described are intended to be within the scope of the invention.

Nucleic acid molecules corresponding to natural variants homologues of a nucleic acid molecule of the invention or the nucleic acid molecule used in the method of the invention, which can also be a cDNA, can be isolated based on their homology to the nucleic acid molecules disclosed herein using the nucleic acid molecule of the invention or the nucleic acid molecule used in the method of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising a sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the respective fine chemical increase after increasing the expression or activity thereof or the activity of a protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

A "non-essential" amino acid residue is a residue that can be altered from the wild-type sequence of one without altering the activity of said polypeptide, whereas an "essential" amino acid residue is required for an activity as mentioned above, e.g. leading to an increase in the respective fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organism can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned activity, e.g. conferring an increase in the respective fine chemical in an organisms or parts thereof that contain changes in amino acid residues that are not essential for said activity. Such polypeptides differ in amino acid sequence from a sequence contained in a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. yet retain said activity described herein. The nucleic acid molecule can comprise a nucleotide sequence encoding a polypeptide, wherein the polypeptide comprises an amino acid sequence at least about 50% identical to an amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. and is capable of participation in the increase of production of the respective fine chemical after increasing its activity, e.g. its expression. Preferably, the protein encoded by the nucleic acid molecule is at least about 60% identical to a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., more preferably at least about 70% identical to one of the sequences as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., even more preferably at least about 80%, 90%, or 95% homologous to a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and most preferably at least about 96%, 97%, 98%, or 99% identical to the sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence which has a 80% homology with sequence SEQ ID No 1982 at the nucleic acid level is understood as meaning a sequence which, upon comparison with the sequence SEQ ID No 1982 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2.912 | Average mismatch: | −2.003 |

For example a sequence which has a 80% homology with sequence SEQ ID No 1983 at the protein level is understood as meaning a sequence which, upon comparison with the sequence SEQ ID No 1983 by the above program algorithm with the above parameter set, has a 80% homology.

Functional equivalents derived from one of the polypeptides as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., according to the invention and are distinguished by essentially the same properties as a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Functional equivalents derived from a nucleic acid sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table I B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of a polypeptide as indicated in Table II, columns 5 or 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. according to the invention and encode polypeptides having essentially the same properties as a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table I B, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

"Essentially the same properties" of a functional equivalent is above all understood as meaning that the functional equivalent has above mentioned activity, e.g. conferring an increase in the respective fine chemical amount while increasing the amount of protein, activity or function of said functional equivalent in an organism, e.g. a microorganism, a plant or plant or animal tissue, plant or animal cells or a part of the same.

A nucleic acid molecule encoding an homologous to a protein sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., preferably of Table II B, column 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. can be created by introducing one or more nucleotide substitutions, additions or deletions into a nucleotide sequence of the nucleic acid molecule of the present invention, in particular as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., such that one or more amino acid substitutions, additions or deletions are introduced into the encoded protein. Mutations can be introduced into the encoding sequences of a sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the respective fine chemical.

Following mutagenesis of one of the sequences shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with a sequence as indicated in Table I, preferably table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or of the nucleic acid sequences derived from a sequences as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from a sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises one or more sequences as indicated in Table I, preferably table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, it is preferred that the nucleic acid molecule comprises as little as possible other nucleotides not shown in any one of sequences as indicated in Table I, preferably table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, a nucleic acid molecule used in the process of the invention is identical to a sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Also preferred is that one or more nucleic acid molecule(s) used in the process of the invention encodes a polypeptide comprising a sequence as indicated in Table II, preferably table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment, the encoded polypeptide used in the process of the invention is identical to the sequences as indicated in Table II, preferably table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, a nucleic acid molecule of the invention or used in the process encodes a polypeptide comprising the sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., comprises less than 100 further nucleotides. In a further embodiment, said nucleic acid molecule comprises less than 30 further nucleotides. In one embodiment, the nucleic acid molecule used in the process is identical to a coding sequence as indicated in Table II, preferably table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Idealerweise würde man in diesen Abschnitten nur column 7 von Table II bevorzugen, wurde auch teilweise so gemacht, andererseits erheblicher Aufwand and ggf. nicht unbedingt notwendig??

Polypeptides (=proteins), which still have the essential biological or enzymatic activity of the polypeptide of the present invention conferring an increase of the respective fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and is expressed under identical conditions.

In one embodiment, the polypeptide of the invention is a homolog consisting of or comprising the sequence as indicated in Table II B, columns 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Homologues of a sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or of a derived sequences as indicated in Table II, columns 5 or 7 lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3' regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound respective fine chemical produced by the selected mutated organisms or parts thereof.

The organisms or part thereof produce according to the herein mentioned process of the invention an increased level of free and/or -bound respective fine chemical compared to said control or selected organisms or parts thereof.

In one embodiment, the organisms or part thereof produce according to the herein mentioned process of the invention an increased level of protein-bound respective fine chemical compared to said control or selected organisms or parts thereof.

Advantageously the selected organisms are mutagenized according to the invention. According to the invention mutagenesis is any change of the genetic information in the genome of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the respective fine chemical production.

The genes of the invention can also be activated by mutagenesis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagenesis as well as the respective agens is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagenesis with N-methyl-N-nitro-nitroso-guanidine.

Other biological method are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungi, a yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention originate from bacteria, for example from Proteobacteria, in particular from Gammaproteobacteria, more preferred from Enterobacteriales, e.g. from the family Enterobacteriaceae, particularly from genera *Escherichia, Salmonella, Klebsiella*, advantageously form the species *Escherichia coli* K12.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; Glycine max*; sunflower linseed or maize or their homologues.

Accordingly, in one embodiment, the invention relates to a nucleic acid molecule which comprises a nucleic acid molecule selected from the group consisting of: (haben die 435 automatisch ergänzt, daher ggf. Hier etwas unübersichtlich)
a) nucleic acid molecule encoding, preferably at least the mature form, of a polypeptide as indicated in Table II, preferably table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.; or a fragment thereof conferring an increase in the amount of the respective fine chemical, in particular, of arginine (lines 30 to 37, 390, 405 and/or 430) and/or glutamate (lines 38 to 43, 386, 387, 391, 396, 399 to 401, 403, 406, 413, 414, 417, 418, 421, 424, 427, 434 and/or 435) and/or proline (lines 44 to 56, 388, 389, 398, 411, 412, 425 and/or 429) and/or glutamine (lines 57 to 62, 392 to 395, 397, 402, 404, 407 to 410, 415, 416, 419, 420, 422, 423, 426, 428 and/or 431 to 433), resp., in an organism or a part thereof
b) nucleic acid molecule comprising, preferably at least the mature form, of a nucleic acid molecule as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or a fragment thereof conferring an increase in the amount of the respective fine chemical in an organism or a part thereof;
c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;
d) nucleic acid molecule encoding a polypeptide whose sequence has at least 50% identity with the amino acid sequence of the polypeptide encoded by the nucleic acid molecule of (a) to (c) and conferring an increase in the amount of the fine chemical in an organism or a part thereof;
e) nucleic acid molecule which hybridizes with a nucleic acid molecule of (a) to (c) under stringent hybridisation conditions and conferring an increase in the amount of the fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;
h) nucleic acid molecule comprising a nucleic acid molecule which is obtained by amplifying a cDNA library or a genomic library using primers or primer pairs as indicated in Table 111, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of the respective fine chemical, in particular, of arginine (lines 30 to 37, 390, 405 and/or 430) and/or glutamate (lines 38 to 43, 386, 387, 391, 396, 399 to 401, 403, 406, 413, 414, 417, 418, 421, 424, 427, 434 and/or 435/or proline (lines 44 to 56, 388, 389, 398, 411, 412, 425 and/or 429) and/or glutamine (lines 57 to 62, 392 to 395, 397, 402, 404, 407 to 410, 415, 416, 419, 420, 422, 423, 426, 428 and/or 431 to 433), resp. in an organism or a part thereof;
i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the fine chemical in an organism or a part thereof;
j) nucleic acid molecule which encodes a polypeptide comprising a consensus sequence as indicated in Table IV, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of the respective fine chemical, in particular, of arginine (lines 30 to 37, 390, 405 and/or 430) and/or glutamate (lines 38 to 43, 386, 387, 391, 396, 399 to 401, 403, 406, 413, 414, 417, 418, 421, 424, 427, 434 and/or, 435) and/or proline (lines 44 to 56, 388, 389, 398, 411, 412, 425 and/or 429) and/or glutamine (lines 57 to 62, 392 to 395, 397, 402, 404, 407 to 410, 415, 416, 419, 420, 422, 423, 426, 428 and/or 431 to 433), resp., in an organism or a part thereof;
k) nucleic acid molecule encoding the amino acid sequence of a polypeptide encoding a domaine of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of the respective fine chemical, in particular, of arginine (lines 30 to 37, 390, 405 and/or 430) and/or glutamate (lines 38 to 43, 386, 387, 391, 396, 399 to 401, 403, 406, 413, 414, 417, 418, 421, 424, 427, 434 and/or 435) and/or proline (lines 44 to 56, 388, 389, 398, 411, 412, 425 and/or 429) and/or glutamine (lines 57 to 62, 392 to 395, 397, 402, 404, 407 to 410, 415, 416, 419, 420, 422, 423, 426, 428 and/or 431 to 433), in an organism or a part thereof; and
l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of a nucleic acid molecule as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or a nucleic acid molecule encoding, preferably at least the mature form of, a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. and conferring an increase in the amount of the respective fine chemical in an organism or a part thereof;

or which encompasses a sequence which is complementary thereto;

whereby, preferably, the nucleic acid molecule according to (a) to (l) distinguishes over the sequence indicated in Table IA, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more nucleotides. In one embodiment, the nucleic acid molecule does not consist of the sequence shown and indicated in Table I A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In one embodiment, the nucleic acid molecule is less than 100%, 99.999%, 99.99%, 99.9% or 99% identical to a sequence indicated in Table I A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, the nucleic acid molecule does not encode a polypeptide of a sequence indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In an other embodiment, the nucleic acid molecule of the present invention is at least 30%, 40%, 50%, or 60% identical and less than 100%, 99.999%, 99.99%, 99.9% or 99% identical to a sequence indicated in Table I A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In a further embodiment the nucleic acid molecule does not encode a polypeptide sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Accordingly, in one embodiment, the nucleic acid molecule of the differs at least in one or more residues from a nucleic acid molecule indicated in Table I A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Accordingly, in one embodiment, the nucleic acid molecule of the present invention encodes a polypeptide, which differs at least in one or more amino acids from a polypeptide indicated in Table II A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, a nucleic acid molecule indicated in Table I A or I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. does not encode a protein of a sequence indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Accordingly, in one embodiment, the protein encoded by a sequences of a nucleic acid according to (a) to (l) does not consist of a sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In a further embodiment, the protein of the present invention is at least 30%, 40%, 50%, or 60% identical to a protein sequence indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. and less than 100%, preferably less than 99.999%, 99.99% or 99.9%, more preferably less than 99%, 985, 97%, 96% or 95% identical to a sequence as indicated in Table I A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

The nucleic acid sequences used in the process are advantageously introduced in a nucleic acid construct, preferably an expression cassette which makes possible the expression of the nucleic acid molecules in an organism, advantageously a plant or a microorganism.

Accordingly, the invention also relates to an nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:

(a) introducing of a nucleic acid construct comprising the nucleic acid molecule of the invention or used in the process of the invention or encoding the polypeptide of the present invention or used in the process of the invention; or (b) introducing of a nucleic acid molecule, including regulatory sequences or factors, which expression increases the expression of the nucleic acid molecule of the invention or used in the process of the invention or encoding the polypeptide of the present invention or used in the process of the invention;

in a cell, or an organism or a part thereof, preferably in a plant, plant cell or a microorganism, and (c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned in particular are various binary and cointegrated vector systems which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula, Pichia, Yerrowia, Saccharomyces, Schizosaccharomyces* or *Candida*.

Host organisms which are especially advantageously selected in the process according to the invention are microorganisms selected from the group of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the firet alternative, the constructs, which comprise the codogenic gene segment or the nucleic acid molecule of the invention or the nucleic acid molecule used in the method of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to a sequence indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or its derivatives, it is advantageous additionally to express and/or mutate further genes in the organisms. Especially advantageously, additionally at least one further gene of the amino acid biosynthetic pathway such as for L-lysine, L-threonine and/or L-methionine and/or L-leucine and/or isoleucine and/or valine is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the amino acids desired since, for example, feedback regulations no longer exist to the same extent or not at all. In addition it might be advantageously to combine one or more of the sequences indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., with genes which generally support or enhances to growth or yield of the target organismen, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the amino acid metabolism, in particular in amino acid synthesis.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine. Furthermore, an advantageous nucleic acid sequence coexpressed can be threonine adlolase and/or lysine decarboxylase as described in the state of the art.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the respective fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60, 70, 80 or 90%, compared with the starting organism, and thus the activity of the enzyme is increased by these figures mentioned compared with the starting organism. An increase in the enzymatic activity means an enzymatic activity which is increased by at least 10%, advantageously at least 20, 30, 40 or 50%, particularly advantageously by at least 60, 70, 80, 90, 100, 200, 300, 500 or 1000%, compared with the starting organism. This leads to an increased productivity of the desired respective fine chemical or of the desired respective fine chemicals.

In a further advantageous embodiment of the process of the invention, the organisms used in the process are those in which simultaneously an arginine and/or glutamate and/or glutamine and/or proline degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or the nucleic acid molecule used in the method of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to to the coding sequence of the nucleic acid molecule of the invention or the nucleic acid molecule used in the method of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the $\Omega$ enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a A/T-rich sequence which act as quantitative enhancers of gene expression in transgenic tobacco and potato plants (Sandhu et al., 1998; Plant Mol. Biol. 37(5):885-96). Beside that, a large variety of cis-active elements have been described which contribute to specific expression pattern, like organ specific expression or induced expression in response to biotic or abiotic stress. Examples are elements which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, lacI$^{q-}$, T7, T5, T3, gal, trc, ara, SP6, $\lambda$-P$_R$ or $\lambda$-P$_L$ promoter, which are advantageously used in Gram-negative bacteria. Further advantageous regulatory sequences are present for example in the Gram-positive promoters amy, dnaK, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4–, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention or the nucleic acid molecule used in the method of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein. This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination arepolyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell Targeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention in a plant can be advantageous. However, inducible expression of the polypeptide of the invention or the polypeptide used in the method of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the inventioncomprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the respective fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signalsThese regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep. 583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion E. coli expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage which harbors a T7 gn1 gene under the transcriptional control of the lacUV 5 promoter.

Other vectors which are suitable in prokaryotic organisms are known to the skilled worker; these vectors are for example in E. coli pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III[113]-B1, λgt11 or pBdCl, in Streptomyces pIJ101, pIJ364, pIJ702 or pIJ361, in Bacillus pUB110, pC194 or pBD214, in Corynebacterium pSA77 or pAJ667.

In a further embodiment, the expression vector is a yeast expression vector. Examples of vectors for expression in the yeasts S. cerevisiae encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 µM, pAG-1, YEp6, YEp13 or pEMBLYe23.

Further vectors, which may be mentioned by way of example, are pALS1, pIL2 or pBB116 in fungi or pLGV23, pGHlac+, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell. Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The amino acids produced can be isolated from the organism by methods with which the skilled worker is familiar. For example via extraction, salt precipitation and/or ion-exchange chromatography. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas (Bioreaktoren and periphere Einrichtungen (Vieweg Verlag, Braunschweig/Wiesbaden, 1994)).

In one embodiment, the present invention relates to a polypeptide encoded by the nucleic acid molecule according to the present invention, preferably conferring an increase in the respective fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with an eukaryotic organism as host cell. E.g., in one embodiment the polypeptide is produced in a plant cell or plant with a nucleic acid molecule derived from a prokaryote or a fungus or an alga or an other microorganism but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in E. coli there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, a native polypeptide conferring the increase of the respective fine chemical in an organism or part thereof can be isolated from cells (e.g., endothelial cells), for example using the antibody of the present invention as described below, e.g. an antibody against a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or an antibody against a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. which can be produced by standard techniques utilizing the polypeptide of the present invention or fragment thereof, i.e., the polypeptide of this invention. Preferred are monoclonal antibodies.

In one embodiment, the present invention relates to a polypeptide having the amino acid sequence encoded by a nucleic acid molecule of the invention or the nucleic acid molecule used in the method of the invention or obtainable by a process of the invention. Said polypeptide confers preferably the aforementioned activity, in particular, the polypeptide confers the increase of the respective fine chemical in a cell or an organism or a part thereof after increasing the cellular activity, e.g. by increasing the expression or the specific activity of the polypeptide.

In one embodiment, the present invention relates to a polypeptide having a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or as encoded by a nucleic acid molecule as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or functional homologues thereof.

In one advantageous embodiment, in the method of the present invention the activity of a polypeptide is increased which comprises or consists of a consensus sequence as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In another embodiment, the present invention relates to a polypeptide comprising or consisting of a consensus sequence as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid or, in an further embodiment, can be replaced and/or absent. In one embodiment, the present invention relates to the method of the present invention comprising a polypeptide or to a polypeptide comprising more than one consensus sequences (of an individual line) as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp In one embodiment not more than 15%, preferably 10%, even more preferred 5%, 4%, 3%, or 2%, most preferred 1% or 0% of the amino acid position indicated by a letter are/is replaced another amino acid or, in an other embodiment, are/is absent and/or replaced. In another embodiment the stretches of non-conserved amino acids, indicated by $(X)_n$ [whereas n indicates the number of X], vary in their length by 20%, preferably by 15 or 10%, even more preferred by 5%, 4%, 3%, 2% or most preferred by only 1%.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence or, in an other embodiment, are absent and/or replaced.

The consensus sequence shown herein was derived from a multiple alignment of the sequences as listed in table II. The consensus sequences of specified domains were derived from a multiple alignment of all sequences. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. YX(21-23)F means that conserved tyrosine and phenylalanine residues are separated from each other by minimum 21 and maximum 23 amino acid residues in all investigated sequences.

The alignment was performed with the Software AlignX (sept 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penality: 10.0; gap extension penality 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 0.9. Presettings were selected to allow also for the alignment of conserved amino acids.

In one advantageous embodiment, the method of the present invention comprises the increasing of a polypeptide comprising or consisting of plant or microorganism specific consensus sequences.

In one embodiment, said polypeptide of the invention distinguishes over a sequence as indicated in Table II A or IIB, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. by one or more amino acids. In one embodiment, polypeptide distinguishes form a sequence as indicated in Table II A or IIB, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. by more than 1, 2, 3, 4, 5, 6, 7, 8 or 9 amino acids, preferably by more than 10, 15, 20, 25 or 30 amino acids, evenmore preferred are more than 40, 50, or 60 amino acids and, preferably, the sequence of the polypeptide of the invention distinguishes from a sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. by not more than 80% or 70% of the amino acids, preferably not more than 60% or 50%, more preferred not more than 40% or 30%, even more preferred not more than 20% or 10%. In an other embodiment, said polypeptide of the invention does not consist of a sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to polypeptide conferring an increase in the respective fine chemical in an organism or part thereof and being encoded by the nucleic acid molecule of the invention or a nucleic acid molecule used in the process of the invention. In one embodiment, the polypeptide of the invention has a sequence which distinguishes from a sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. by one or more amino acids. In an other embodiment, said polypeptide of the invention does not consist of the sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. In a further embodiment, said polypeptide of the present invention is less than 100%, 99.999%, 99.99%, 99.9% or 99% identical. In one embodiment, said polypeptide does not consist of the sequence encoded by a nucleic acid molecules as indicated in Table I A or IB, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

In one embodiment, the present invention relates to a polypeptide having an activity of a protein as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., which distinguishes over a sequence as indicated in Table IIA or table II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more amino acids, preferably by more than 5, 6, 7, 8 or 9 amino acids, preferably by more than 10, 15, 20, 25 or 30 amino acids, evenmore preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, poly-peptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized. The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention-chemicals, more preferably less than about 20% chemical precursors or non-polypeptide of the invention-chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

Non polypeptide of the invention-chemicals are e.g. polypeptides having not the activity of a polypeptide indicated in Table II, columns 3, 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

A polypeptide of the invention can participate in the process of the present invention. The polypeptide or a portion thereof comprises preferably an amino acid sequence which is sufficiently homologous to an amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. The portion of the protein is preferably a biologically active portion as described herein. Preferably, the polypeptide used in the process of the invention has an amino acid sequence identical to a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the nucleotide sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or which is homologous thereto, as defined above.

Accordingly the polypeptide of the present invention can vary from a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., in amino acid sequence due to natural variation or mutagenesis, as described in detail herein.

Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of a sequence as indicated in Table II A or II B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: -2.003.

Biologically active portions of an polypeptide of the present invention include peptides comprising amino acid sequences derived from the amino acid sequence of the polypeptide of the present invention or used in the process of the present invention, e.g., an amino acid sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of a protein having essentially the activity of the polypeptides as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., but having differences in the sequence from said wild-type protein. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention or the polypeptide used in the method of the invention may be utilized to generate plants or parts thereof, expressing one or more wildtype protein(s) or one or more mutated protein encoding nucleic acid molecule(s) or polypeptide molecule(s) of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition comprising the respective fine chemical or a recovered respective fine chemical, in particular, the fine chemical, free or in protein-bound form.

Preferably, the compound is a composition comprising the methionine or a recovered methionine, in particular, the fine chemical, free or in protein-bound form.

The invention also provides chimeric or fusion proteins.

As used herein, an "chimeric protein" or "fusion protein" comprises an polypeptide operatively linked to a polypeptide which does not confer above-mentioned activity, in particular, which does not confer an increase of content of the respective fine chemical in a cell or an organism or a part thereof, if its activity is increased.

In one embodiment, a reference to a protein (=polypeptide) of the invention or as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., refers to a polypeptide having an amino acid sequence corresponding to the polypeptide of the invention or used in the process of the invention, whereas a "non-polypeptide of the invention" or "other polypeptide" not being indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., refers to a polypeptide having an amino acid sequence corresponding to a protein which is not substantially homologous a polypeptide of the invention, preferably which is not substantially homologous to a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., e.g., a protein which does not confer the activity described herein or annotated or known for as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and which is derived from the same or a different organism. In one embodiment, a "non-polypeptide of the invention" or "other polypeptide" not being indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., does not confer an increase of the respective fine chemical in an organism or part thereof.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a polypeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention or the nucleic acid molecule used in the method of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modelling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention or the polypeptide used in the method of the invention and its substrates or binding factors can be used for the identification or design of mutants with modulated binding or turn over activities. For example, the active centre of the polypeptide of the present invention can be modelled and amino acid residues participating in the catalytic reaction can be modulated to increase or decrease the binding of the substrate to activate or improve the polypeptide. The identification of the active centre and the amino acids involved in the catalytic reaction facilitates the screening for mutants having an increased activity.

The sequences shown in column 5 of the Tables I to IV herein have also been described under their Gene/ORF Locus Name as described in the Table I, II, III or IV, column 3.

In an especially preferred embodiment, the polypeptide according to the invention furthermore also does not have the sequences of those proteins which are encoded by the sequences shown in the known listed Gene/ORF Locus Names or as described in the Tables, column 3.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof. The "anti-sense strand" contains an inverted sequence, which is complementary to that of the "sense strand".

In addition the expression levels and/or the activity can be modified by the introduction of mutations in the regulatory or coding regions of the nucleic acids of the invention. Furthermore antibodies can be expressed which specifically binds to a polypeptide of interest and thereby blocks it activity. The protein-binding factors can, for example, also be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention or the nucleic acid molecule used in the method of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5'-UTR or 3'-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule to the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention or the nucleic acid molecule used in the method of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methyl-inosine, 2,2-dimethylguanine, 2-methyladenine, 2-methylguanine, 3-methylcytosine, 5-methylcytosine, N6-adenine, 7-methylguanine, 5-methylaminomethyluracil, 5-meth-oxyaminomethyl-2-thiouracil, beta-D-mannosylqueosine, 5'-methoxycarboxymethyl-uracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy-acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention or the polypeptide used in the method of the invention having aforementioned the respective fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention or the nucleic acid molecule used in the method of the invention can be an α-anomeric nucleic acid molecule. An α-anomeric nucleic acid molecule forms specific double-stranded hybrids with complementary RNA in which, contrary to the usual units, the strands run parallel to each other (Gaultier et al. (1987) *Nucleic Acids. Res.* 15:6625-6641). The antisense nucleic acid molecule can also comprise a 2'-o-methyl-ribonucleotide (Inoue et al. (1987) *Nucleic Acids Res.* 15:6131-6148) or a chimeric RNA-DNA analogue (Inoue et al. (1987) *FEBS Lett.* 215:327-330).

Further the antisense nucleic acid molecule of the invention or the nucleic acid molecule used in the method of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts encoding the polypeptide of the invention or the polypeptide used in the method of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or the nucleic acid molecule used in the method of the invention or coding a protein used in the process of the invention or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J. W. (1993) *Science* 261:1411-1418.

The antisense molecule of the present invention comprises also a nucleic acid molecule comprising a nucleotide sequences complementary to the regulatory region of an nucleotide sequence encoding the natural occurring polypeptide of the invention or the polypeptide used in the method of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6): 569-84; Helene, C. et al. (1992) *Ann. N.Y. Acad. Sci.* 660:27-36; and Maher, L. J. (1992) *Bioassays* 14(12): 807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as *Neurospora, zebrafish, Drosophila*, mice, planaria, humans, *Trypanosoma, petunia* or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of a nucleic acid sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived therefrom), bring about altered metabolic activity by the reduction in the expression of a nucleic acid sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and/or homologs thereof. In a double-stranded RNA molecule for reducing the expression of an protein encoded by a nucleic acid sequence sequences as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in non-mammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extra-cellularly (for example into the interstitial space).

Advantageously the RNAi method leads to only a partial loss of gene function and therefore enables the skilled worker to study a gene dose effect in the desired organism and to fine tune the process of the invention. Furthermore it enables a person skilled in the art to study multiple functions of a gene.

Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the respective fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with *Agrobacteria*, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

*Agrobacteria* transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J and Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol. Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22 (2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the respective fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. the polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. e.g. encoding a polypeptide having protein activity, as indicated in Table II, columns 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. Due to the above mentioned activity the respective fine chemical content in a cell or an organism is increased. For example, due to modulation or manipulation, the cellular activity of the polypeptide of the invention or nucleic acid molecule of the invention is increased, e.g. due to an increased expression or specific activity of the subject matters of the invention in a cell or an organism or a part thereof. Transgenic for a polypeptide having an activity of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., means herein that due to modulation or manipulation of the genome, an activity as annotated for a polypeptide as indicated in Table II, column 3, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp. e.g. having a sequence as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., is increased in a cell or an organism or a part thereof. Examples are described above in context with the process of the invention "Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either
a) the nucleic acid sequence, or
b) a genetic control sequence linked operably to the nucleic acid sequence, for example a promoter, or
c) (a) and (b)
are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of a promoter of a polypeptide of the invention with the corresponding protein-encoding sequence—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the respective fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the respective fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the above-mentioned plant genus, more preferred from abovementioned plants species.

Transgenic plants comprising the amino acids synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The amino acids produced in the process according to the invention may, however, also be isolated from the plant in the form of their free amino acids or bound in proteins. Amino acids produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention or the nucleic acid molecule used in the method of the invention.

In another embodiment, the present invention relates also to a transgenic microorganism comprising the nucleic acid molecule of the invention or the nucleic acid molecule used in the method of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced amino acid composition or the produced respective fine chemical is isolated.

In this manner, more than 50% by weight, advantageously more than 60% by weight, preferably more than 70% by weight, especially preferably more than 80% by weight, very especially preferably more than 90% by weight, of the fine chemicals produced in the process can be isolated. The resulting fine chemicals can, if appropriate, subsequently be further purified, if desired mixed with other active ingredients such as vitamins, amino acids, carbohydrates, antibiotics and the like, and, if appropriate, formulated.

In one embodiment, the fatty acid is the fine chemical.

The amino acids obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the amino acid composition produced or the fine chemical produced if desired and formulating the product with a pharmaceutical acceptable carrier or formulating the product in a form acceptable for an application in agriculture. A further embodiment according to the invention is the use of the amino acids produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus, Corynebacterium, Micrococcus, Brevibacterium, Rhodococcus, Nocardia, Caseobacter* or *Arthrobacter* or Gram-negative bacteria such as the genera *Escherichia, Flavobacterium* or *Salmonella* or yeasts such as the genera *Rhodotorula, Hansenula* or *Candida*. Particularly advantageous organisms are selected from the group of genera *Corynebacterium, Brevibacterium, Escherichia, Bacillus, Rhodotorula, Hansenula, Candida, Claviceps* or *Flavobacterium*. It is very particularly advantageous to use in the process of the invention microorganisms selected from the group of genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing arginine and/or glutamate and/or glutamine and/or proline compound-containing fine chemicals, in particular the fine chemical, it is possible to use as arginine and/or glutamate and/or glutamine and/or proline amino acid source organic compounds such as, for example, citrulline, argininosuccinate, ornithine, aspartate, 2-Oxoglutarate, glutamyl, glutamic-semialdehyde, Pyrroline-5-carboxylate, Glutamine or else organic arginine and/or glutamate and/or glutamine and/or proline acid precursor compounds.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P. M. Rhodes, P. F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular L-arginine and/or L-glutamate and/or L-proline and/or L-tryptophane, L-methionine, L-threonine and/or L-lysine, normally have a dry matter content of from 7.5 to 25% by weight. Sugar-limited fermentation is additionally advantageous, at least at the end, but especially over at least 30% of the fermentation time. This means that the concentration of utilizable sugar in the fermentation medium is kept at, or reduced to, 0 to 3 g/l during this time.

The fermentation broth is then processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the amino acid produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavourings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the fine chemical production in a cell, comprising the following steps:
a) contacting e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;
b) identifying the nucleic acid molecules, which hybridize under relaxed stringent conditions with the nucleic acid molecule of the present invention in particular to the nucleic acid molecule sequence as indicated in Table I, preferably Table I B, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and, optionally, isolating the full length cDNA clone or complete genomic clone;
c) introducing the candidate nucleic acid molecules in host cells, preferably in a plant cell or a microorganism, appropriate for producing the fine chemical;
d) expressing the identified nucleic acid molecules in the host cells;
e) assaying the fine chemical level in the host cells; and
f) identifying the nucleic acid molecule and its gene product which expression confers an increase in the fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In an other embodiment, the present invention relates to a method for the identification of a gene product conferring an increase in the respective fine chemical production in a cell, comprising the following steps:
(a) identifying nucleic acid molecules of an organism; which can contain a candidate gene encoding a gene product conferring an increase in the respective fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
(b) introducing the candidate nucleic acid molecules in host cells, preferably in a plant cells or microorganisms, appropriate for producing the respective fine chemical;
(c) expressing the identified nucleic acid molecules in the host cells;
(d) assaying the respective fine chemical level in the host cells; and
(e) identifying the nucleic acid molecule and its gene product which expression confers an increase in the respective fine chemical level in the host cell after expression compared to the wild type.

Eventually gene products conferring the increase in the respective fine chemical production can also be identify according to a identical or similar 3D structure in step (a) and by the above described method.

The nucleic acid molecules identified can then be used for the production of the respective fine chemical in the same way as the nucleic acid molecule of the present invention. Accordingly, in one embodiment, the present invention relates to a process for the production of the respective fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the respective fine chemical to said plant comprising:
a) contacting cells which express the polypeptide of the present invention or its mRNA with a candidate compound under cell cultivation conditions;
b) assaying an increase in expression of said polypeptide or said mRNA;
c) comparing the expression level to a standard response made in the absence of said candidate compound; whereby, an increased expression over the standard indicates that the compound is stimulating production of the respective fine chemical.

Furthermore, in one embodiment, the present invention relates to a method for the screening for agonists or an antagonist of the activity of the polypeptide of the present invention or used in the process of the present invention, e.g. a polypeptide conferring an increase of the respective fine chemical in an organism or a part thereof after increasing the activity in an organism or a part thereof, comprising:
(a) contacting cells, tissues, plants or microorganisms which express the polypeptide according to the invention with a candidate compound or a sample comprising a plurality of compounds under conditions which permit the expression the polypeptide of the present invention or used in the process of the present invention;
(b) assaying the respective fine chemical level or the polypeptide expression level in the cell, tissue, plant or microorganism or the media the cell, tissue, plant or microorganisms is cultured or maintained in; and
(c) identifying a agonist or antagonist by comparing the measured the respective fine chemical level or polypeptide of the invention or used in the invention expression level with a standard the respective fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to process for the identification of a compound conferring increased the respective fine chemical production in a plant or microorganism, comprising the steps:

(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and (b) identifying if the compound is an effective agonist by detecting the presence or absence or increase of a signal produced by said readout system.

The screen for a gene product or an agonist conferring an increase in the respective fine chemical production can be performed by growth of an organism for example a microorganism in the presence of growth reducing amounts of an inhibitor of the synthesis of the respective fine chemical. Better growth, e.g. higher dividing rate or high dry mass in comparison to the control under such conditions would identify a gene or gene product or an agonist conferring an increase in fine chemical production.

One can think to screen for increased production of the respective fine chemical by for example searching for a resistance to a drug blocking the synthesis of the respective fine chemical and looking whether this effect is dependent on the activity or expression of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or a homolog thereof, e.g. comparing the phenotyp of nearly identical organisms with low and high activity of a protein as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., after incubation with the drug.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the respective fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the respective fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the arm, e.g. buffers and solutions for hydridization assays, e.g. the aforementioned solutions and buffers, further and means for Southern-, Western-, Northern—etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the respective fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or the polypeptide used in the method of the invention or comprising the steps of the method according to the invention for the identification of said compound, agonist or antagonist; and formulating the nucleic acid molecule, the vector or the polypeptide of the invention or the polypeptide used in the method of the invention or the agonist, or compound identified according to the methods or processes of the present invention or with use of the subject matters of the present invention in a form applicable as plant agricultural composition.

In another embodiment, the present invention relates to a method for the production of a "the respective fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the respective fine chemical production as mentioned and related organisms; mapping of genomes; identification and localization of sequences of interest; evolutionary studies; determination of regions required for function; modulation of an activity.

The nucleic acid molecule of the invention or the nucleic acid molecule used in the method of the invention, the vector of the invention or the nucleic acid construct of the invention may also be useful for the production of organisms resistant to inhibitors of the amino acid production biosynthesis pathways. In particular, the overexpression of the polypeptide of the present invention may protect plants against herbicides, which block the amino acid, in particular the respective fine chemical, synthesis in said plant. Inhibitors may inhibit one or more of the steps for the synthesis of methionine. The first committed step for the synthesis of Lys, Met and Thr is the first step, in which aspartate is phosphorylated to aspartyl-b-phosphate, catalyzed by aspartokinase: E. coli has 3 isozymes of aspartokinase that respond differently to each of the 3 amino acids, with regard to enzyme inhibition and feedback inhibition. The biosynthesis of lysine, methionine and threonine are not, then, controlled as a group. The pathway from aspartate to lysine has 10 steps. The pathway from aspartate to threonine has 5 steps. The pathway from aspartate to methionine has 7 steps. Regulation of the three pathways also occurs at the two branch points:

b-Aspartate-semialdehyde (homoserine and lysine)

Homoserine (threonine and methionine)

The regulation results from feedback inhibition by the amino acid products of the branches, indicated in the brackets above. One important step in the synthesis of this group of 3 amino acids is the step in which homocysteine is converted to methionine, catalyzed by the enzyme methionine synthase:

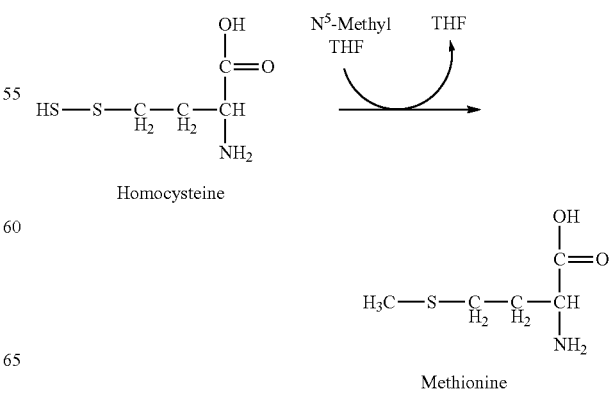

In this reaction, homocysteine is methylated to methionine, and the C1 donor is N5-methyl-THF. Thus, inhibition of one or more of the methionine synthesis enzymes, including also the provision of donor molecules, can inhibit the synthesis of methionine.

Examples of herbicides blocking the amino acid synthesis in plants are for example sulfonylurea and imidazolinone herbicides, which catalyze the first step in branched-chain amino acid biosynthesis. Inhibitors of the methionine synthesis may for example described in Danishpajooh IO, 2001 Nitric oxide inhibits methionine synthase activity in vivo and disrupts carbon flow through the folate pathway. J. Biol. Chem. 276: 27296-27303; Datko AH, 1982 Methionine biosynthesis in Lemna—inhibitor studies. Plant Physiol. 69: 1070-1076; Lavrador K, 1998 A new series of cyclic amino acids as inhibitors of S-adenosyl L-methionine synthetase. Bioorg. Med. Chem. Lett. 8: 1629-1634; Thompson G A, 1982 Methionine synthesis in Lemna—inhibition of cystathionine gamma-synthase by propargylglycine. Plant Physiol. 70: 1347-1352. In some organisms the methionine synthesis is inhibited by ethanol, lead, mercury, aluminium, thimerosal, cupper, N2O, as e.g. discussed in M. Waly, H. Oleteanu et al., 2004, Molecular Psychiatry, 1-13.

Interestingly, *Arabidopsis* seed germination was strongly delayed in the presence of DL-propargylglycine, a specific inhibitor of methionine synthesis. Furthermore, this compound totally inhibited seedling growth. These phenotypic effects were largely alleviated upon methionine supplementation in the germination medium. The results indicated that methionine synthase and S-adenosylmethionine synthetase are fundamental components controlling metabolism in the transition from a quiescent to a highly active state during seed germination. Moreover, the observed temporal patterns of accumulation of these proteins are consistent with an essential role of endogenous ethylene in *Arabidopsis* only after radicle protrusion; s. Gallarado, K., 2002, Importance of methionine biosynthesis for *Arabidopsis* seed germination and seedling growth, Physiolgia Plantarum, 116(2), pp 238-247. Accordingly, the overexpression of a polypeptide of the present invention in a plant may protect the plant against a herbicide inhibiting methionine synthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention or the nucleic acid molecule used in the method of the invention may be sufficiently homologous to the sequences of related species such that these nucleic acid molecules may serve as markers for the construction of a genomic map in related organism.

Accordingly, the present invention relates to a method for breeding plants for the production of the respective fine chemical, comprising
  (a) providing a first plant variety produced according to the process of the invention preferably (over)expressing the nucleic acid molecule of the invention or the nucleic acid molecule used in the method of the invention;
  (b) crossing the first plant variety with a second plant variety; and
  (c) selecting the offspring plants which overproduce the respective fine chemical by means of analysis the distribution of a molecular marker in the offspring representing the first plant variety and its capability to (over) produce the respective fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention or the nucleic acid molecule used in the method of the invention and/or its expression level. Accordingly, the molecular marker can be a probe or a PCR primer set useful for identification of the genomic existence or genomic localisation of the nucleic acid molecule of the invention or the nucleic acid molecule used in the method of the invention, e.g. in a Southern blot analysis or a PCR or its expression level, i.g. in a Northern Blot analysis or a quantitative PCR.

Accordingly, in one embodiment, the present invention relates to the use of the nucleic acid molecule of the present invention or encoding the polypeptide of the present invention as molecular marker for breeding, especially for breeding for a high or low respective fine chemical production.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention or the nucleic acid molecule used in the method of the invention can be used for the identification of other nucleic acids conferring an increase of the respective fine chemical after expression.

Further, the nucleic acid molecule of the invention or the nucleic acid molecule used in the method of the invention or a fragment of a gene conferring the expression of the polypeptide of the invention or the polypeptide used in the method of the invention, preferably comprising the nucleic acid molecule of the invention, can be used for marker assisted breeding or association mapping of the respective fine chemical derived traits Accordingly, the nucleic acid of the invention, the polypeptide of the invention, the nucleic acid construct of the invention, the organisms, the host cell, the microorgansims, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other amino acids, in particular methionine, threonine, alanine, glutamine, glutamic acid, valine, asparagine, phenylalanine, leucine, proline, Tryptophan tyrosine, isoleucine and arginine.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the fine chemical in a organism or part thereof, e.g. in a cell.

Further, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist or the agonist identified with the method of the invention, the antibody of the present invention, the antisense molecule of the present invention or the nucleic acid molecule identified with the method of the present invention, can be used for the preparation of an agricultural composition.

Furthermore, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, antagonist or the agonist identified with the method of the invention, the antibody of the present invention, the antisense molecule of the present invention or the nucleic acid molecule identified with the method of the present invention, can be used for the identification and production of compounds capable of conferring a modulation of the respective fine chemical levels in an organism or parts thereof, preferably to identify and produce compounds conferring an increase of the respective fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nlm.nih.gov/PubMed/medline.html. Further databases and addresses, such as hftp://www.ncbi.nlm.nih.gov/, hftp://www.infobiogen.fr/, hftp://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.

---

1) Increase of the metabolites:
   Max: maximal x-fold (normalised to wild type)-
   Min: minimal x-fold (normalised to wild type)
2) Decrease of the metabolites:
   Max: maximal x-fold (normalised to wild type)   (minimal decrease)
   Min: minimal x-fold (normalised to wild type)   (maximal decrease)

---

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning into in *Escherichia coli*

A DNA polynucleotide with a sequence as indicated in Table I, column 5 and encoding a polypeptide as listed in Table 1 below, was cloned into the plasmids pBR322 (Sutcliffe, J. G. (1979) Proc. Natl. Acad. Sci. USA, 75: 3737-3741); pACYC177 (Change & Cohen (1978) J. Bacteriol. 134: 1141-1156); plasmids of the pBS series (pBSSK+, pBSSK– and others; Stratagene, LaJolla, USA) or cosmids such as SuperCosi (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of *Haemophilus Influenzae* Rd., Science 269; 496-512)".

Example 3

In-Vivo and In-Vitro Mutagenesis

An in vivo mutagenesis of *Corynebacterium glutamicum* for the production of the respective fine chemical can be carried out by passing a plasmid DNA (or another vector DNA) through *E. coli* and other microorganisms (for example *Bacillus* spp. or yeasts such as *Saccharomyces cerevisiae*), which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widly used as chemical agents for random in-vitro mutagenesis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagenesis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. DpnI site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired respective fine chemical.

Example 4

DNA Transfer Between *Escherichia coli* and *Corynebacterium glutamicum*

Several *Corynebacterium* and *Brevibacterium* species comprise endogenous plasmids (such as, for example, pHM1519 or pBL1) which replicate autonomously (for a review, see, for example, Martin, J. F. et al. (1987) Biotechnology 5: 137-146). Shuttle vectors for *Escherichia coli* and *Corynebacterium glutamicum* can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), which have a replication origin for, and suitable marker from, *Corynebacterium glutamicum* added. Such replication origins are preferably taken from endogenous plasmids, which have been isolated from *Corynebacterium* and *Brevibacterium* species. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim). There are many examples in the literature of the preparation of a large multiplicity of shuttle vectors which are replicated in *E. coli* and *C. glutamicum* and which can be used for various purposes including the overexpression of genes (see, for example, Yoshihama, M. et al. (1985) J. Bacteriol. 162: 591-597, Martin, J. F. et al., (1987) Biotechnology, 5: 137-146 and Eikmanns, B. J. et al. (1992) Gene 102: 93-98). Suitable vectors, which replicate in coryneform bacteria are, for example, pZ1 (Menkel et al., Appl. Environ. Microbiol., 64, 1989: 549-554) pEkEx1 (Eikmanns et al., Gene 102, 1991: 93-98) or pHS2-1 (Sonnen et al, Gene 107, 1991: 69-74). These vectors are based on the cryptic plasmids pHM1519, pBL1 or pGA1. Other plasmid vectors such as, for example, those based on pCG4 (U.S. Pat. No. 4,489,160), pNG2 (Serwold-Davis et al., FEMS Microbiol. Lett., 66, 1990: 119-124) or pAG1 (U.S. Pat. No. 5,158,891) can be used in the same manner.

Using standard methods, it is possible to clone a gene of interest into one of the above-described shuttle vectors and to introduce such hybrid vectors into *Corynebacterium glutamicum* strains. The transformation of *C. glutamicum* can be achieved by protoplast transformation (Kastsumata, R. et al., (1984) J. Bacteriol. 159, 306-311), electroporation (Liebl, E. et al., (1989) FEMS Microbiol. Letters, 53: 399-303) and in those cases where specific vectors are used also by conjugation (such as, for example, described in Schäfer, A., et al. (1990) J. Bacteriol. 172: 1663-1666). Likewise, it is possible to transfer the shuttle vectors for *C. glutamicum* to *E. coli* by preparing plasmid DNA from *C. glutamicum* (using standard methods known in the art) and transforming it into *E. coli*. This transformation step can be carried out using standard methods, but preferably using an Mcr-deficient *E. coli* strain, such as NM522 (Gough & Murray (1983) J. Mol. Biol. 166: 1-19).

If the transformed sequence(s) is/are to be integrated advantageously into the genome of the coryneform bacteria, standard techniques known to the skilled worker also exist for this purpose. Examples, which are used for this purpose are plasmid vectors as they have been described by Remscheid et al. (Appl. Environ. Microbiol., 60, 1994: 126-132) for the duplication and amplification of the hom-thrB operon. In this method, the complete gene is cloned into a plasmid vector which is capable of replication in a host such as *E. coli*, but not in *C. glutamicum*. Suitable vectors are, for example, pSUP301 (Simon et al., Bio/Technology 1, 1983: 784-791), pKIBmob or pK19mob (Schäfer et al., Gene 145, 1994: 69-73), pGEM-T (Promega Corp., Madison, Wis., USA), pCR2.1-TOPO (Schuman, J. Biol. Chem., 269, 1994: 32678-32684, U.S. Pat. No. 5,487,993), pCR® Blunt (Invitrogen, Groningen, the Netherlands) or pEM1 (Schrumpf et al., J. Bacteriol., 173, 1991: 4510-4516).

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* or other microorganisms by a variety of methods, which are known in the art, e.g. as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicates the presence and the amount of the sought mutant protein in the cell. However, other methods are also known.

Example 6

Growth of Genetically Modified *Corynebacterium glutamicum*: Media and Culture Conditions Genetically modified *Corynebacteria* are grown in synthetic or natural growth media. A number of different growth media for *Corynebacteria* are known and widely available (Lieb et al. (1989) Appl. Microbiol. Biotechnol. 32: 205-210; von der Osten et al. (1998) Biotechnology Letters 11: 11-16; Patent DE 4 120 867; Liebl (1992) "The Genus *Corynebacterium*", in: The Procaryotes, Vol. II, Balows, A., et al., Ed. Springer-Verlag).

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as WWI, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar and 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or $NH_4OH$. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by introducing of a preculture of seed organisms.

For example, the media are inoculated by introducing of a saline solution of *C. glutamicum* cells from CM plates or by addition of a liquid preculture of this bacterium.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 8

Analysis of the Effect of the Nucleic Acid Molecule on the Production of the Amino Acids The effect of the genetic modification in C. glutamicum on the production of an amino acid can be determined by growing the modified microorganisms under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 9

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 1982 for the Expression in Plants

Unless otherwise specified, standard methods as described in Sambrook et al., Molecular Cloning: A laboratory manual, Cold Spring Harbor 1989, Cold Spring Harbor Laboratory Press are used.

SEQ ID NO: 1982 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of Saccharomyces cerevisiae (strain S288C; Research Genetics, Inc., now Invitrogen) or Escherichia coli (strain MG1655; E. coli Genetic Stock Center), 50 pmol forward primer, 50 pmol reverse primer, 2.5 u Pfu Turbo DNA polymerase. The amplification cycles were as follows:

1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C. The composition for the protocol of the Herculase polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Herculase polymerase. The amplification cycles were as follows:

1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID No: 1982:
  i) forward primer (SEQ ID No: 2046)
    atgaataacg aacccttacg tccc
  ii) reverse primer (SEQ ID No: 2047)
    ttacatatcc tcatgaaatt cttcaagt Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector. The PCR-products, produced by Pfu Turbo DNA polymerase, were phosphorylated using a T4 DNA polymerase using a standard protocol (e.g. MBI Fermentas) and cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well. The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID No: 1982

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000) "A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The *agrobacteria* generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1 000 seeds per dish. The dishes were covered with a hood and placed in the stratification facility (8 h, 110µ, µmol/m$^2$/s$^{-1}$, 22° C.; 16 h, dark, 6° C.). After 5 days, the dishes were placed into the short-day controlled environment chamber (8 h 130 µmol/m$^2$/s$^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 µE, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 µl Silwett L77 (Crompton S. A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the described changes in comparison with wild-types were caused by the introduced genes.

As an alternative, the amino acids can be detected advantageously via HPLC separation in ethanolic extract as described by Geigenberger et al. (Plant Cell & Environ, 19, 1996: 43-55).

The results of the different plant analyses can be seen from the table which follows:

TABLE 1

| ORF | Metabolite | Method | Min | Max |
|---|---|---|---|---|
| b0730 | Glutamate | LC | 1.55 | 2.15 |
| b0730 | Proline | GC | 1.35 | 3.72 |
| b1829 | Glutamine | LC | 1.50 | 1.68 |
| b1829 | Arginine | LC | 1.45 | 12.41 |
| b2699 | Proline | GC + LC | 1.32 | 2.41 |
| YBR030W | Proline | LC | 1.51 | 3.82 |
| YBR204C | Glutamate | GC | 1.55 | 1.76 |
| YDL106C | Proline | GC + LC | 1.51 | 1.99 |
| YDR271C | Proline | GC + LC | 1.36 | 5.82 |
| YDR316W | Arginine | LC | 1.45 | 2.02 |
| YEL045C | Proline | GC | 1.41 | 1.89 |
| YER173W | Glutamine | GC | 1.86 | 3.85 |
| YER173W | Proline | GC | 1.34 | 2.91 |
| YFL013C | Glutamate | GC + LC | 1.81 | 2.34 |
| YFL050C | Proline | GC | 1.44 | 1.74 |
| YFR042W | Glutamine | GC | 1.41 | 1.43 |
| YGR104C | Glutamate | LC | 1.64 | 1.96 |
| YGR135W | Proline | GC | 1.32 | 3.89 |
| YHR130C | Arginine | LC | 1.67 | 1.85 |
| YIL150C | Proline | GC | 1.33 | 4.04 |
| YKR057W | Arginine | LC | 1.57 | 5.57 |
| YKR057W | Glutamine | GC | 1.41 | 3.84 |

TABLE 1-continued

| ORF | Metabolite | Method | Min | Max |
|---|---|---|---|---|
| YNL090w | Proline | GC + LC | 1.73 | 6.29 |
| YNL090w | Arginine | LC | 1.54 | 4.23 |
| YPR024W | Glutamate | LC | 1.26 | 1.43 |
| YPR133W-A | Glutamate | GC | 1.34 | 1.68 |
| YPR138C | Proline | GC | 1.54 | 6.20 |
| b0695 | Arginine | LC | 1.51 | 4.19 |
| b1284 | Arginine | LC | 1.47 | 2.83 |
| b1827 | Proline | GC | 1.42 | 2.26 |
| b1852 | Glutamine | GC | 1.40 | 1.42 |
| b2095 | Arginine | LC | 1.55 | 1.59 |
| b4265 | Glutamate | GC | 1.32 | 1.47 |
| b0050 | Glutamate | LC | 1.37 | 1.97 |
| b0057 | Glutamate | GC + LC | 1.35 | 1.83 |
| b0138 | Proline | LC | 1.50 | 2.80 |
| b0149 | Proline | GC | 1.33 | 2.20 |
| b0161 | Arginine | LC | 7.28 | 9.81 |
| b0161 | Glutamate | LC | 1.35 | 1.65 |
| b0161 | Glutamine | GC | 1.43 | 3.56 |
| b0486 | Glutamine | LC | 1.51 | 2.28 |
| b0849 | Glutamine | LC | 1.37 | 1.50 |
| b0970 | Glutamine | GC + LC | 1.59 | 3.80 |
| b1343 | Glutamine | LC | 1.37 | 1.39 |
| b1343 | Glutamate | GC | 1.48 | 1.99 |
| b1360 | Proline | GC | 1.33 | 1.70 |
| b1693 | Glutamate | LC | 1.39 | 2.49 |
| b1736 | Glutamate | LC | 1.46 | 1.97 |
| b1738 | Glutamate | LC | 1.38 | 2.07 |
| b1886 | Glutamate | LC | 1.36 | 2.24 |
| b1896 | Glutamate | GC | 1.67 | 2.62 |
| b1926 | Glutamine | LC | 1.07 | 1.27 |
| b2307 | Arginine | LC | 1.95 | 3.47 |
| b2307 | Glutamate | LC | 1.35 | 1.89 |
| b2414 | Glutamate | LC | 1.30 | 1.56 |
| b2426 | Glutamate | LC | 1.31 | 1.62 |
| b2489 | Glutamate | LC | 1.33 | 1.44 |
| b2553 | Proline | LC | 1.49 | 1.68 |
| b2553 | Glutamate | GC + LC | 1.55 | 1.90 |
| b2664 | Proline | GC + LC | 1.35 | 9.53 |
| b2710 | Glutamate | LC | 1.35 | 1.38 |
| b2818 | Glutamine | GC | 1.45 | 6.19 |
| b2818 | Glutamate | GC | 1.50 | 2.29 |
| b3064 | Glutamine | GC | 1.72 | 2.41 |
| b3074 | Glutamate | LC | 1.34 | 1.85 |
| b3116 | Glutamate | GC + LC | 1.35 | 1.98 |
| b3160 | Glutamine | LC | 1.38 | 1.64 |
| b3160 | Glutamine | GC | 1.51 | 2.89 |
| b3166 | Glutamine | LC | 1.29 | 1.40 |
| b3169 | Glutamine | GC + LC | 1.55 | 2.11 |
| b3169 | Glutamate | GC + LC | 1.42 | 2.40 |
| b3231 | Glutamine | GC | 1.50 | 2.64 |
| b3619 | Glutamate | LC | 1.40 | 2.22 |
| b3644 | Proline | GC + LC | 1.32 | 3.41 |
| b3680 | Glutamine | GC | 1.50 | 2.99 |
| b3791 | Glutamine | LC | 1.28 | 1.57 |
| b3791 | Glutamate | LC | 1.39 | 1.57 |
| b3919 | Proline | GC | 1.35 | 2.18 |
| b3936 | Arginine | LC | 2.20 | 4.98 |
| b4004 | Glutamine | LC | 1.30 | 1.36 |
| b4074 | Glutamine | GC | 1.40 | 1.42 |
| b4133 | Glutamine | GC | 1.59 | 3 12 |
| b4346 | Glutamate | GC | 1.38 | 1.44 |
| YFL019C | Glutamate | GC + LC | 1.81 | 2.34 |

Column 3 shows the metabolite/respective fine chemical analyzed. Columns 4 and 5 shows the ratio of the analyzed metabolite/respective fine chemical between the transgenic plants and the wild type; Increase of the metabolites: Max: maximal x-fold (normalised to wild type)-Min: minimal x-fold (normalised to wild type). Decrease of the metabolites: Max: maximal x-fold (normalised to wild type) (minimal decrease), Min: minimal x-fold (normalised to wild type) (maximal decrease). Column 6 indicates the analytical method.

When the analyses were repeated independently, all results proved to be significant.

Example 14a

Engineering Ryegrass Plants by Over-Expressing the Polynucleotide Characterized in the Invention, e.g. Derived from *Saccharomyces cerevisiae, E. Coli* or Plants or an Other Organism Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 μm in size) are coated with plasmid DNA according to method of Sanford et al., 1993 and are delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14b

Engineering Soybean Plants by Over-Expressing the Polynucleotide Characterized in the Invention, e.g. Derived from *Saccharomyces cerevisiae, E. Coli* or Plants or Another Organism Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 µE–m–2s–1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1 agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing the Polynucleotide Characterized in the Invention, e.g. Derived from *Saccharomyces cerevisiae, E. Coli* or Plants or Another Organism Amplification of for example SEQ ID NO: 1 was achieved as described in example 10 except that the upstream primer SEQ ID NO:3 and the reverse primer SEQ ID NO: 4 contained the following 5"extensions:
  i) forward primer: 5"-GGGTCGCTCCTACGCG-3" SEQ ID NO: 68243
  ii) reverse primer 5"-CTCGGGCTCGGCGTCC-3" SEQ ID NO: 68246
Vector Construction The maize transformation vector for constitutive expression was constructed as follows.

As base vectors, the vectors EG073qcz (SEQ ID NO 68240) and EG065qcz (SEQ ID NO: 68241) were chosen. The MCS from EG065qcz was deleted by digestion of the vector with Asp718 and PstI, followed by blunting of the vector using T4 DNA polymerase. The blunted vector was religated. The vector generated was called EG065-MCS. The LIC cassette was cloned in the vector EG065-MCS by hybridizing the following oligos, generating a DNA fragment with ends able to ligate into a SmaI and SacI digested vector. This fragment was ligated into the vector EG065-MCS that had been digested with SmaI and SacI. The generated vector was called EG065-LIC. The complete expression cassette comprising ScBV (Schenk (1999) Plant Mol Biol 39(6):1221-1230) promoter, LIC cassette and terminator was cut out of EG065-LIC with AscI and PacI and ligated into the vector EG073qcz that had previously been digested with AscI and PacI. The resulting binary vector for corn transformation was called pMME0607 (SEQ ID NO: 68242).
Oligo POCCLicMluISacIIfw: gggtcgctcctacgcgtcaatgatc-cgcggacgccgagcccgagct (SEQ ID NO: 68244)
Oligo POCCLicMluISacIrev: cgggctcggcgtccgcggatcat-tgacgcgtaggagcgaccc (SEQ ID NO: 68245)

For cloning of a polynucleotide of the invention, for example the ORF of SEQ ID NO: 1, from *S. cerevisiae* the vector DNA was treated with the restriction enzyme MluI and SacII. The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 14c.a

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of *agrobacterium* for around 30 minutes. Excised embryos were removed from liquid and then co-cultivated in the dark at 22° C. with *Agrobacterium tumefaciens* on solid MS-based callus induction medium containing 2 mg/l 2,4-D, 10 um AgNO3, and 200 um Acetosyringone. After several days of co-cultivation, embryos were transferred to MS-based media containing 2 mg/l 2, 4, 10 um AgNO3 and 200 mg/l Timentin the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 uE/m2/s−1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s−1. After plants were grown to 4-6 leaf stage they were moved to 14 inch pots containing Metro-Mix® 360. Supplemental metal-halide lamps were used to maintain >800uE/m2/s−1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

Example 14c.b

Growth of T0 Corn Plants for Metabolic Analysis

Plants were grown under the following standardized conditions to properly stage them for T0 sampling. T0 plantlets were transferred to 14" pots in the greenhouse after they grow to 4-6 leaf stage (1-3 weeks). pBSMM232 containing plants were produced carried along with each experiment to serve as controls for T0 samples. Plantlets were moved to 14" pots on Tuesday of each week. Plants were grown for 9 days until the 7-13 leaf stage is reached. On Thursday between 10 am and 2 pm leaf sampling was performed on the 3rd youngest ($1^{st}$ fully elongated). Within 30 seconds 250-500 mg of leaf material (without midrib), were removed weighed and placed into pre-extracted glass thimbles in liquid nitrogen. A second sample (opposite side of the midrib) from each plant was sampled as described above for qPCR analysis.

Example 14c.c

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 7 days old, they were subjected to select transgenic plants. For this purposes pieces of plant leaves were sampled and a PCR reaction with the respective primers for the transgene were performed. Plants exhibiting the transgene were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Example 14c.d

Metabolic Analysis of Maize Leaves

The modifications identified in accordance with the invention, in the content of above-described metabolites, were identified by the following procedure.
a) Sampling and Storage of the Samples Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen.

The time elapsing between cutting the leave to freezing it in liquid nitrogen amounted to not more than 30 seconds. The boxes were stored in a freezer at −80° C., an shipped on dry ice.
b) Lyophilization During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.
c) Extraction Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-de-canoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.
d) Processing the Lipid Phase for the LC/MS or LC/MS/MS Analysis The lipid extract, which had been evaporated to dryness was taken up in mobile phase. The HPLC was run with gradient elution.

The polar extract, which had been evaporated to dryness was taken up in mobile phase. The HPLC was run with gradient elution.
e) Derivatization of the Lipid Phase for the GC/MS Analysis For the transmethanolysis, a mixture of 140 μl of chloroform, 37 μl of hydrochloric acid (37% by weight HCl in water), 320 μl of methanol and 20 μl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 μl for 1.5 hours at 60° C.) in a tightly sealed vessel. 20 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 μl of N-methyl-N-(trimethylsilyl)-2,2,2-trifluoroacetamide (MSTFA) was carried out for 30 minutes at 60° C., again in the tightly sealed vessel. The final volume before injection into the GC was 220 μl.
f) Derivatization of the Polar Phase for the GC/MS Analysis The methoximation of the carbonyl groups was carried out by reaction with methoxyamine hydrochloride (20 mg/ml in pyridine, 50 μl for 1.5 hours at 60° C.) in a tightly sealed vessel. 10 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 μl of N-methyl-N-(trimethylsilyl)-2,2,2-trifluoroacetamide (MSTFA) was carried out for 30 minutes at 60° C., again in the tightly sealed vessel. The final volume before injection into the GC was 110 μl.
g) Analysis of the Various Plant Samples The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Transformation of maize (*Zea Mays* L.) can also be performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673 can be used to provide constitutive expression of the trait gene.

Excised embryos can be grown on callus induction medium, then maize regeneration medium, containing imidazolinone as a selection agent. The Petri plates can be incubated in the light at 25° C. for 2-3 weeks, or until shoots develop. The green shoots can be transferred from each embryo to maize rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which can be PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants can exhibited similar phenotypes as the T1 plants. Hybrid plants (F1 progeny) of homozygous transgenic plants and non-transgenic plants can also exhibit increased similar phenotypes.

Example 14d

Engineering Wheat Plants by Over-Expressing the Polynucleotide Characterized in the Invention, e.g. Derived from *Saccharomyces cerevisiae, E. Coli* or Plants or Another Organism Transformation of wheat can be performed with the method described by Ishida et al. (1996 Nature Biotech. 14745-50). The cultivar Bobwhite (available from CYMMIT, Mexico) can commonly be used in transformation. Immature embryos can be co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

After incubation with *Agrobacterium*, the embryos can be grown on callus induction medium, then regeneration medium, containing imidazolinone as a selection agent. The Petri plates can be incubated in the light at 25° C. for 2-3 weeks, or until shoots develop. The green shoots can be transferred from each embryo to rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants exhibited similar phenotypes.

Example 14e

Engineering Rapeseed/Canola Plants by Over-Expressing the Polynucleotide Characterized in the Invention, e.g. Derived from *Saccharomyces cerevisiae, E. coli* or Plants or Another Organism Cotyledonary petioles and hypocotyls of 5-6 day-old young seedlings can be used as explants for tissue culture and transformed according to Babic et al. (1998, Plant Cell Rep 17: 183-188). The commercial cultivar Westar (Agriculture Canada) can be the standard variety used for transformation, but other varieties can be used.

*Agrobacterium tumefaciens* LBA4404 containing a binary vector can be used for canola transformation. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium Tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767, 366 and 6,225,105). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

Canola seeds can be surface-sterilized in 70% ethanol for 2 min., and then in 30% Clorox with a drop of Tween-20 for 10 min, followed by three rinses with sterilized distilled water.

Seeds can be then germinated in vitro 5 days on half strength MS medium without hormones, 1% sucrose, 0.7% Phytagar at 23° C., 16 hr. light. The cotyledon petiole explants with the cotyledon attached can be excised from the in vitro seedlings, and can be inoculated with *Agrobacterium* by dipping the cut end of the petiole explant into the bacterial suspension. The explants can be then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants can be transferred to MSBAP-3 medium containing 3 mg/l BAP, cefotaxime, carbenicillin, or timentin (300 mg/l) for 7 days, and can then be cultured on MSBAP-3 medium with cefotaxime, carbenicillin, or timentin and selection agent until shoot regeneration. When the shoots are 5-10 mm in length, they can be cut and transferred to shoot elongation medium (MSBAP-0.5, containing 0.5 mg/l BAP). Shoots of about 2 cm in length can be transferred to the rooting medium (MS0) for root induction.

Samples of the primary transgenic plants (T0) can be analyzed by PCR to confirm the presence of T-DNA. These results can be confirmed by Southern hybridization in which DNA is electrophoresed on a 1 agarose gel and are transferred to a positively charged nylon membrane (Roche Diagnostics). The PCR DIG Probe Synthesis Kit (Roche Diagnostics) can be used to prepare a digoxigenin-labelled probe by PCR, and used as recommended by the manufacturer.

Example 14f

Engineering Alfalfa Plants by Over-Expressing the Polynucleotide Characterized in the Invention, e.g. Derived from *Saccharomyces cerevisiae* or *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) can be selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. The 34S promoter (GenBank Accession numbers M59930 and X16673) can be used to provide constitutive expression of the trait gene.

The explants can be cocultivated for 3 d in the dark on SH induction medium containing 288 mg/L Pro, 53 mg/L thioproline, 4.35 g/L K2SO4, and 100 µm acetosyringinone. The explants can be washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos can be transferred to BOi2Y development medium containing no growth regulators, no antibiotics, and 50 g/L sucrose. Somatic embryos are subsequently germinated on half-strength Murashige-Skoog medium. Rooted seedlings can be transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing the Polynucleotide Characterized in the Invention, Derived e.g. From *Saccharomyces cerevisiae*, *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 15

Metabolite Profiling Info from *Zea mays*

*Zea mays* plants were engineered, grown and analyzed as described in Example 14c.

The results of the different *Zea mays* plants analysed can be seen from Table 2 which follows:

TABLE 2

| ORF_NAME | Metabolite | Min | Max |
|---|---|---|---|
| YKR057W | Glutamine | 2.30 | 2.48 |
| YIL150C | Proline | 1.67 | 2.08 |
| b1284 | Arginine | 1.37 | 2.39 |
| b1829 | Glutamine | 1.41 | 2.17 |
| b1896 | Glutamate | 1.48 | 2.65 |
| b2553 | Proline | 1.76 | 6.63 |
| b2553 | Glutamine | 1.54 | 9.51 |
| b2664 | Proline | 1.78 | 2.38 |
| b3116 | Glutamate | 1.67 | 1.91 |

Table 2 exhibits the metabolic data from maize, shown in either T0 or T1, describing the increase in proline and/or glutamine and/or arginine and/or glutamate in genetically modified corn plants expressing the *Saccharomyces cerevisiae* nucleic acid sequence YIL150C or YKR057W or *E. coli* nucleic acid sequence b1284, b1829, b1896, b2553, b2664 or b3116 resp.

In one embodiment, in case the activity of the *Saccharomyces* cerevisiae protein YIL150C or its homologs, e.g. "a chromatin binding protein, required for S-phase (DNA synthesis) initiation or completion" or its homologs, is increased in corn plants, preferably, an increase of the fine chemical proline between 67% and 108% is conferred.

In case the activity of the *Saccharomyces cerevisiae* protein YKR057W or a ribosomal protein, similar to S21 ribosomal proteins, involved in ribosome biogenesis and translation or its homolog, is increased in corn plants, preferably, an increase of the fine chemical glutamine between 130% and 148% is conferred.

In one embodiment, in case the activity of the *E. coli* protein b1284 or its homologs, e.g. "a transcriptional regulator for regulation of C-compound and carbohydrate utilization, transcriptional control, transcriptional repressor, DNA binding", is increased in corn plants, preferably, an increase of the fine chemical arginine between 37% and 139% is conferred.

In one embodiment, in case the activity of the *E. coli* protein b1829 or its homologs, e.g. "the activity of a heat shock protein with protease activity (htpx)", is increased in corn plants, preferably, an increase of the fine chemical glutamine between 41% and 117% is conferred.

In one embodiment, in case the activity of the *E. coli* protein b1896 or its homologs, e.g. "a trehalose-6-phosphate synthase or its homologs", is increased in corn plants, preferably, an increase of the fine chemical glutamate between 48% and 165% is conferred.

In one embodiment, in case the activity of the *E. coli* protein b2553 or its homologs, e.g. "the activity of a regulatory protein P-II for glutamine synthetase", is increased in corn plants, preferably, an increase of the fine chemical proline between 76% and 563% is conferred and/or an increase of the fine chemical glutamine between 54% and 851% is conferred.

In one embodiment, in case the activity of the *E. coli* protein b2664 or its homologs, e.g. "the activity of a hydrogenase Fe-subunit", is increased in corn plants, preferably, an increase of the fine chemical proline between 78% and 138% is conferred.

In one embodiment, in case the activity of the *E. coli* protein b3116 or its homologs, e.g. "the activity of a L-threonine/L-serine permease, anaerobically inducible (HAAAP family)", is increased in corn plants, preferably, an increase of the fine chemical glutamate between 67% and 91% is conferred.

Example 16

Preparation of Homologous Sequences from Plants

Different plants can be grown under standard or varying conditions in the greenhouse. RNA can be extracted following the protocol of Jones, Dunsmuir and Bedbrook (1985) EMBO J. 4: 2411-2418. Approx. 1 gram of tissue material from various organs is ground in liquid nitrogen. The powder is transferred to a 13 ml Falcon tube containing 4.5 ml NTES buffer (100 mM NaCl, 10 mM Tris/HCl pH 7.5, 1 mM EDTA, 1% SDS; in RNase-free water) and 3 ml phenol/chloroform/isoamylalcohol (25/24/1), immediately mixed and stored on ice. The mixture is spun for 10 minutes at 7000 rpm using a centrifuge (Sorval; SM24 or SS34 rotor). The supernatant is transferred to a new tube, ¹/₁₀th volume of 3 M NaAcetate (pH 5.2; in RNase-free water) and 1 volume of isopropanol is added, mixed at stored for 1 hour or overnight at −20° C. The mixture is spun for 10 minutes at 7000 rpm. The supernatant is discarded and the pellet washed with 70% ethanol (v/v). The mixture is spun for 5 minutes at 7000 rpm, the supernatant is discarded and the pellet is air-dried. 1 ml RNase-free water is added and allow the DNA/RNA pellet to dissolve on ice at 4 C. The nucleic acid solution is transferred to a 2 ml Eppendorf tube and 1 ml of 4 M LiAcetate is added. After mixing the solution is kept for at least 3 hours, or overnight, at 4 C. The mixture is spun for 10 minutes at 14000 rpm, the supernatant discarded, the pellet washed with 70% Ethanol, air-dried and dissolved in 200 µl of RNase-free water.

Total RNA can be used to construct a cDNA-library according to the manufacturer's protocol (for example using the ZAP-cDNA synthesis and cloning kit of Stratagene, La Jolla, USA). Basically, messenger RNA (mRNA) is primed in the first strand synthesis with a oligo(dT) linker—primer and is reverse-transcribed using reverse transcriptase. After second strand cDNA synthesis, the double-stranded cDNA is ligated into the Uni-ZAP XR vector. The Uni-ZAP XR vector allows in vivo excision of the pBluescript phagemid. The polylinker of the pBluescript phagemid has 21 unique cloning sites flanked by T3 and T7 promoters and a choice of 6 different primer sites for DNA sequencing. Systematic single run sequencing of the expected 5 prime end of the clones can allow preliminary annotation of the sequences for example with the help of the pedant pro Software package (Biomax, Munchen). Clones for the nucleic acids of the invention or used in the process according to the invention can be identified based on homology search with standard algorithms like blastp or gap. Identified putative full length clones with identity or high homology can be subjected to further sequencing in order to obtain the complete sequence.

Additional new homologous sequences can be identified in a similar manner by preparing respective cDNA libraries from various plant sources as described above. Libraries can then be screened with available sequences of the invention under low stringency conditions for example as described in Sambrook et al., Molecular Cloning: A laboratory manual, Cold Spring Harbor 1989, Cold Spring Harbor Laboratory Press. Purified positive clones can be subjected to the in vivo excision and complete sequencing. A pairwise sequence alignment of the original and the new sequence using the blastp or gap program allows the identification of orthologs, meaning homologous sequences from different organisms, which should have a sequence identity of at least 30%. Furthermore the conservation of functionally important amino acid residues or domains, which can be identified by the alignment of several already available paralogs, can identify a new sequence as an new orthologs.

Alternatively libraries can be subjected to mass sequencing and obtained sequences can be stored in a sequence database, which then can be screened for putative orthologs by different search algorithms, for example the tbastn algorithm to search the obtained nucleic acid sequences with a amino acid sequence of the invention. Clones with the highest sequence identity are used for a complete sequence determination and orthologs can be identified as described above.

Item 1. A process for the production of arginine and/or glutamate and/or proline and/or glutamine, which comprises
  (a) increasing or generating the activity of a protein as indicated in Table II, columns 5 or 7, lines 34 to 37, 390, 405 and/or 430 for arginine
and/or lines 43, 386, 387, 391, 396, 399 to 401, 403, 406, 413, 414, 417, 418, 421, 424, 427, 434, and/or 435 for glutamate
and/or lines 54 to 56, 388, 389, 398, 411, 412, 425 and/or 429 for proline
and/or lines 62, 392 to 395, 397, 402, 404, 407 to 410, 415, 416, 419, 420, 422, 423, 426, 428 and/or 431 to 433 for glutamine resp., or a functional equivalent thereof in a non-human organism, or in one or more parts thereof; and
  (b) growing the organism under conditions which permit the production of arginine and/or glutamate and/or proline and/or glutamine resp. in said organism.

Item 2. A process for the production of arginine and/or glutamate and/or proline and/or glutamine, comprising the increasing or generating in an organism or a part thereof the expression of at least one nucleic acid molecule comprising a nucleic acid molecule selected from the group consisting of:
  (a) nucleic acid molecule encoding of a polypeptide as indicated in Table II, columns 5 or 7, lines 34 to 37, 390, 405 and/or 430 for arginine
    and/or lines 43, 386, 387, 391, 396, 399 to 401, 403, 406, 413, 414, 417, 418, 421, 424, 427, 434, and/or 435 for glutamate
    and/or lines 54 to 56, 388, 389, 398, 411, 412, 425 and/or 429 for proline
    and/or lines 62, 392 to 395, 397, 402, 404, 407 to 410, 415, 416, 419, 420, 422, 423, 426, 428 and/or 431 to 433 for glutamine resp., or a fragment thereof, which confers an increase in the amount of arginine and/or glutamate and/or proline and/or glutamine in an organism or a part thereof;
  b) nucleic acid molecule comprising of a nucleic acid molecule as indicated in Table I, columns 5 or 7, lines 34 to 37, 390, 405 and/or 430 for arginine
    and/or lines 43, 386, 387, 391, 396, 399 to 401, 403, 406, 413, 414, 417, 418, 421, 424, 427, 434, and/or 435 for glutamate
    and/or lines 54 to 56, 388, 389, 398, 411, 412, 425 and/or 429 for proline
    and/or lines 62, 392 to 395, 397, 402, 404, 407 to 410, 415, 416, 419, 420, 422, 423, 426, 428 and/or 431 to 433 for glutamine resp.;
  c) nucleic acid molecule whose sequence can be deduced from a polypeptide sequence encoded by a nucleic acid molecule of (a) or (b) as a result of the degeneracy of the genetic code and conferring an increase in the amount of arginine and/or glutamate and/or proline and/or glutamine in an organism or a part thereof;
  d) nucleic acid molecule which encodes a polypeptide which has at least 50% identity with the amino acid sequence of the polypeptide encoded by the nucleic acid molecule of (a) to (c) and conferring an increase in the amount of arginine and/or glutamate and/or proline and/or glutamine in an organism or a part thereof;
  e) nucleic acid molecule which hybidizes with a nucleic acid molecule of (a) to (c) under stringent hybridisation conditions and conferring an increase in the amount of arginine and/or glutamate and/or proline and/or glutamine in an organism or a part thereof;
  f) nucleic acid molecule which encompasses a nucleic acid molecule which is obtained by amplifying nucleic acid molecules from a cDNA library or a genomic library using the primers or primer pairs as indicated in Table III, columns 5 or 7, lines 34 to 37, 390, 405 and/or 430 for arginine
    and/or lines 43, 386, 387, 391, 396, 399 to 401, 403, 406, 413, 414, 417, 418, 421, 424, 427, 434, and/or 435 for glutamate
    and/or lines 54 to 56, 388, 389, 398, 411, 412, 425 and/or 429 for proline
    and/or lines 62, 392 to 395, 397, 402, 404, 407 to 410, 415, 416, 419, 420, 422, 423, 426, 428 and/or 431 to 433 for glutamine resp., and conferring an increase in the amount of arginine and/or glutamate and/or proline and/or glutamine in an organism or a part thereof;
  g) nucleic acid molecule encoding a polypeptide which is isolated with the aid of monoclonal antibodies against a polypeptide encoded by one of the nucleic acid molecules of (a) to (f) and conferring an increase in the amount of arginine and/or glutamate and/or proline and/or glutamine in an organism or a part thereof;
  h) nucleic acid molecule encoding a polypeptide comprising a consensus as indicated in Table IV, column 7, lines 34 to 37, 390, 405 and/or 430 for arginine
    and/or lines 43, 386, 387, 391, 396, 399 to 401, 403, 406, 413, 414, 417, 418, 421, 424, 427, 434, and/or 435 for glutamate
    and/or lines 54 to 56, 388, 389, 398, 411, 412, 425 and/or 429 for proline
    and/or lines 62, 392 to 395, 397, 402, 404, 407 to 410, 415, 416, 419, 420, 422, 423, 426, 428 and/or 431 to 433 for glutamine resp., and conferring an increase in the amount of arginine and/or glutamate and/or proline and/or glutamine in an organism or a part thereof; and i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical in an organism or a part thereof.

or comprising a sequence which is complementary thereto.

Item 3. The process of item 1 or 2, comprising recovering of the free or bound arginine and/or glutamate and/or proline and/or glutamine.

Item 4. The process of any one of item 1 to 3, comprising the following steps:
(a) selecting an organism or a part thereof expressing a polypeptide encoded by the nucleic acid molecule characterized in item 2;
(b) mutagenizing the selected organism or the part thereof;
(c) comparing the activity or the expression level of said polypeptide in the mutagenized organism or the part thereof with the activity or the expression of said polypeptide of the selected organisms or the part thereof;
(d) selecting the mutated organisms or parts thereof, which comprise an increased activity or expression level of said polypeptide compared to the selected organism or the part thereof;
(e) optionally, growing and cultivating the organisms or the parts thereof; and
(f) recovering, and optionally isolating, the free or bound arginine and/or glutamate and/or proline and/or glutamine produced by the selected mutated organisms or parts thereof.

Item 5. The process of any one of items 1 to 4, wherein the activity of said protein or the expression of said nucleic acid molecule is increased or generated transiently or stably.

Item 6. An isolated nucleic acid molecule comprising a nucleic acid molecule selected from the group consisting of:
a) nucleic acid molecule encoding of a polypeptide as indicated in Table II, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., or a fragment thereof, which confers an increase in the amount of arginine and/or glutamate and/or proline and/or glutamine in an organism or a part thereof;
b) nucleic acid molecule comprising of a nucleic acid molecule as indicated in Table I, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp.;
c) nucleic acid molecule whose sequence can be deduced from a polypeptide sequence encoded by a nucleic acid molecule of (a) or (b) as a result of the degeneracy of the genetic code and conferring an increase in the amount of arginine and/or glutamate and/or proline and/or glutamine in an organism or a part thereof;
d) nucleic acid molecule which encodes a polypeptide which has at least 50% identity with the amino acid sequence of the polypeptide encoded by the nucleic acid molecule of (a) to (c) and conferring an increase in the amount of arginine and/or glutamate and/or proline and/or glutamine in an organism or a part thereof;
e) nucleic acid molecule which hybidizes with a nucleic acid molecule of (a) to (c) under stringent hybridisation conditions and conferring an increase in the amount of arginine and/or glutamate and/or proline and/or glutamine in an organism or a part thereof;
f) nucleic acid molecule which encompasses a nucleic acid molecule which is obtained by amplifying nucleic acid molecules from a cDNA library or a genomic library using the primers or primer pairs as indicated in Table III, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of arginine and/or glutamate and/or proline and/or glutamine in an organism or a part thereof;
g) nucleic acid molecule encoding a polypeptide which is isolated with the aid of monoclonal antibodies against a polypeptide encoded by one of the nucleic acid molecules of (a) to (f) and conferring an increase in the amount of arginine and/or glutamate and/or proline and/or glutamine in an organism or a part thereof;
h) nucleic acid molecule encoding a polypeptide comprising a consensus as indicated in Table IV, column 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., and conferring an increase in the amount of arginine and/or glutamate and/or proline and/or glutamine in an organism or a part thereof; and
i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of the fine chemical in an organism or a part thereof.

whereby the nucleic acid molecule distinguishes over the sequence as indicated in Table I A, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more nucleotides.

Item 7. A nucleic acid construct which confers the expression of the nucleic acid molecule of item 6, comprising one or more regulatory elements.

Item 8. A vector comprising the nucleic acid molecule as defined in item 6 or the nucleic acid construct of item 7.

Item 9. The vector as defined in item 8, wherein the nucleic acid molecule is in operable linkage with regulatory sequences for the expression in a prokaryotic or eukaryotic, or in a prokaryotic and eukaryotic, host.

Item 10. A host cell, which has been transformed stably or transiently with the vector as defined in item 9 or 10 or the nucleic acid molecule as defined in item 6 or the nucleic acid construct of item 7 or produced as defined in item any one of items 2 to 5.

Item 11. The host cell of item 10, which is a transgenic host cell.

Item 12. The host cell of item 10 or 11, which is a plant cell, an animal cell, a microorganism, or a yeast cell, a fungus cell, a prokaryotic cell, an eukaryotic cell or an archaebacterium.

Item 13. A process for producing a polypeptide, wherein the polypeptide is expressed in a host cell as defined in any one of items 10 to 12.

Item 14. A polypeptide produced by the process as defined in item 13 or encoded by the nucleic acid molecule as defined in item 6 whereby the polypeptide distinguishes over a sequence as indicated in Table II A, columns 5 or 7, lines 34 to 37, 390, 405 and/or 430 and/or lines 43, 386, 387, 391, 396, 399 to 401, 403, 406, 413, 414, 417, 418, 421, 424, 427, 434, and/or 435 and/or lines 54 to 56, 388, 389, 398, 411, 412, 425 and/or 429 and/or lines 62, 392 to 395, 397, 402, 404, 407 to 410, 415, 416, 419, 420, 422, 423, 426, 428 and/or 431 to 433 resp., by one or more amino acids.

Item 15. An antibody, which binds specifically to the polypeptide as defined in item 14.

Item 16. A plant tissue, propagation material, harvested material or a plant comprising the host cell as defined in item 12 which is plant cell or an *Agrobacterium*.

Item 17. A method for screening for agonists and antagonists of the activity of a polypeptide encoded by the nucleic acid molecule of item 6 conferring an increase in the amount of arginine and/or glutamate and/or proline and/or glutamine in an organism or a part thereof comprising:
(a) contacting cells, tissues, plants or microorganisms which express the a polypeptide encoded by the nucleic acid molecule of item 6 conferring an increase in the amount of arginine and/or glutamate and/or proline and/or glutamine in an organism or a part thereof with a candidate compound or a sample comprising a plurality of compounds under conditions which permit the expression the polypeptide;
(b) assaying the arginine and/or glutamate and/or proline and/or glutamine level or the polypeptide expression level in the cell, tissue, plant or microorganism or the media the cell, tissue, plant or microorganisms is cultured or maintained in; and
(c) identifying a agonist or antagonist by comparing the measured arginine and/or glutamate and/or proline and/or glutamine level or polypeptide expression level with a standard arginine and/or glutamate and/or proline and/or glutamine or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Item 18. A process for the identification of a compound conferring increased arginine and/or glutamate and/or proline and/or glutamine production in a plant or microorganism, comprising the steps:
a) culturing a plant cell or tissue or microorganism or maintaining a plant expressing the polypeptide encoded by the nucleic acid molecule of item 6 conferring an increase in the amount of arginine and/or glutamate and/or proline and/or glutamine in an organism or a part thereof and a readout system capable of interacting with the polypeptide under suitable conditions which permit the interaction of the polypeptide with dais readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of item 5 conferring an increase in the amount of arginine and/or glutamate and/or proline and/or glutamine in an organism or a part thereof;
b) identifying if the compound is an effective agonist by detecting the presence or absence or increase of a signal produced by said readout system.

Item 19. A method for the identification of a gene product conferring an increase in arginine and/or glutamate and/or proline and/or glutamine production in a cell, comprising the following steps:
(a) contacting the nucleic acid molecules of a sample, which can contain a candidate gene encoding a gene product conferring an increase in arginine and/or glutamate and/or proline and/or glutamine after expression with the nucleic acid molecule of item 6;
(b) identifying the nucleic acid molecules, which hybridise under relaxed stringent conditions with the nucleic acid molecule of item 6;
(c) introducing the candidate nucleic acid molecules in host cells appropriate for producing arginine and/or glutamate and/or proline and/or glutamine;
(d) expressing the identified nucleic acid molecules in the host cells;
(e) assaying the arginine and/or glutamate and/or proline and/or glutamine level in the host cells; and
(f) identifying nucleic acid molecule and its gene product which expression confers an increase in the arginine and/or glutamate and/or proline and/or glutamine level in the host cell in the host cell after expression compared to the wild type.

Item 20. A method for the identification of a gene product conferring an increase in arginine and/or glutamate and/or proline and/or glutamine production in a cell, comprising the following steps:
(a) identifiying in a data bank nucleic acid molecules of an organism; which can contain a candidate gene encoding a gene product conferring an increase in the arginine and/or glutamate and/or proline and/or glutamine amount or level in an organism or a part thereof after expression, and which are at least 20% homolog to the nucleic acid molecule of item 6;
(b) introducing the candidate nucleic acid molecules in host cells appropriate for producing arginine and/or glutamate and/or proline and/or glutamine;
(c) expressing the identified nucleic acid molecules in the host cells;
(d) assaying the arginine and/or glutamate and/or proline and/or glutamine level in the host cells; and
(e) identifying nucleic acid molecule and its gene product which expression confers an increase in the arginine and/or glutamate and/or proline and/or glutamine level in the host cell after expression compared to the wild type.

Item 21. A method for the production of an agricultural composition comprising the steps of the method of any one of items 17 to 20 and formulating the compound identified in any one of items 17 to 20 in a form acceptable for an application in agriculture.

Item 22. A composition comprising the nucleic acid molecule of item 6, the polypeptide of item 14, the nucleic acid construct of item 7, the vector of any one of items 8 or 9, an antagonist or agonist identified according to item 17, the compound of item 18, the gene product of item 19 or 20, the antibody of item 15, and optionally an agricultural acceptable carrier.

Item 23. Use of the nucleic acid molecule as defined in item 6 for the identification of a nucleic acid molecule conferring an increase of arginine and/or glutamate and/or proline and/or glutamine after expression.

Item 24. Use of the polypeptide of item 14 or the nucleic acid construct item 7 or the gene product identified according to the method of item 19 or 20 for identifying compounds capable of conferring a modulation of arginine and/or glutamate and/or proline and/or glutamine levels in an organism.

Item 25. Food or feed composition comprising the nucleic acid molecule of item 6, the polypeptide of item 14, the nucleic acid construct of item 7, the vector of item 8 or 9, the antagonist or agonist identified according to item 17, the antibody of item 14, the plant or plant tissue of item 16, the harvested material of item 16, the host cell of item 10 to 12 or the gene product identified according to the method of item 19 or 20.

Item 26. Use of the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 16, the host cell of item 10 to 12 or the gene product identified according to the method of item 19 or 20 for the protection of a plant against a arginine and/or glutamate and/or proline and/or glutamine synthesis inhibiting herbicide.

The present invention relates to a process for the production of the fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

In a further embodiment, the present invention relates to a further process for the production of fine chemicals as defined below and the corresponding embodiments as described herein as follows.

The present invention relates to a process for the production of a fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

Plants produce several important secondary metabolites from phenylalanine through the phenylpropanoid pathway. Such substances include flavonoids, lignins, tannins, salicylic acid and hydroxycinnamic acid esters. Recent work on the phenylpropanoid pathway has shown that the traditional view of lignin biosynthesis is incorrect. Although the hydroxylation and methylation reactions of the pathway were long thought to occur at the level of the free hydroxycinnamic aicds, it turns now out, that the enzymes catalyzing phenylpropanoid 3-hydroxylation and 3-O-methylation reactions uses shikimate and CoA conjugates as substrates. The recent cloning of a aldehyde dehydrogenase involved in ferulic acid and sinapic acid biosynthesis suggest that both substances are derived at least in part through oxidation of coniferaldehyde and sinapaldehyde (see Nair et al., 2004, Plant Cell, 16, 544-554 and citations therein).

Ferulic acid is a substance found in the seeds and leaves of most plants, especially in the brans of grasses such as wheat, rice, and oats. Its chemical structure strongly resembles that of curcumin, the substance responsible for the yellow color of the spice turmeric.

The amount of ferulic acid in plant materials varies widely depending on the species and growing conditions; supplements are therefore a more reliable source of this substance than food or unprocessed herbal materials.

Ferulic acid has antioxidant properties that make it an important anti-aging supplement, and they also contribute to ferulic acid's other potential uses. These include applications in diabetes, cardiovascular disease, cancer, neuroprotection, bone degeneration, menopause, immunity, and (perhaps) athletic performance.

In male rats fed a high cholesterol diet, ferulic acid supplementation significantly lowered total cholesterol and triglyceride concentrations in the blood, as compared to a control group. Moreover, HDL ('good cholesterol') is increased with ferulic acid supplementation.

Like many other dietary substances, ferulic acid is an antioxidant—but it is an unusually good one. It is especially good at neutralizing the free radicals known as 'superoxide', 'hydroxyl radical', and 'nitric oxide'. It acts synergistically with other antioxidants, giving them extra potency. In addition, ferulic acid can be activated to even higher antioxidant activity by exposure to UV light, suggesting that it might help to protect skin from sun damage.

In microbiological applications ferulic acid is useful as a substrate for vanillin production, as for example described in WO 9735999 or DE19960106 or for melanin production (WO 9720944).

Cinnamic acids, which include caffeic and ferulic acids, are also powerful antioxidants. Experiments have found that these compounds can stop the growth of cancer cells.

In addition sinapic acid is an intermediate in syringyl lignin biosynthesis in angiosperms, and in some taxa serves as a precursor for soluble secondary metabolites. The biosynthesis and accumulation of the sinapate esters sinapoylglucose, sinapoylmalate, and sinapoylcholine are developmentally regulated in at least *Arabidopsis* and other members of the Brassicaceae (Ruegger et al., 1999, 119(1): 101-10, 1999).

Due to these interesting physiological roles and agrobiotechnological potential of ferulic acid or sinapic acid there is a need to identify the genes of enzymes and other proteins involved in ferulic acid or sinapic acid metabolism, and to generate mutants or transgenic plant lines with which to modify the ferulic acid or sinapic acid content in plants.

One way to increase the productive capacity of biosynthesis is to apply recombinant DNA technology. Thus, it would be desirable to produce ferulic acid or sinapic acid in plants. That type of production permits control over quality, quantity and selection of the most suitable and efficient producer organisms. The latter is especially important for commercial production economics and therefore availability to consumers. In addition it is desirable to produce ferulic acid or sinapic acid in plants in order to increase plant productivity and resistance against biotic and abiotic stress as discussed before.

Methods of recombinant DNA technology have been used for some years to improve the production of fine chemicals in microorganisms and plants by amplifying individual biosynthesis genes and investigating the effect on production of fine chemicals. It is for example reported, that the xanthophyll astaxanthin could be produced in the nectaries of transgenic tobacco plants. Those transgenic plants were prepared by *Argobacterium tumifaciens*-mediated transformation of tobacco plants using a vector that contained a ketolase-encoding gene from *H. pluvialis* denominated crtO along with the Pds gene from tomato as the promoter and to encode a leader sequence. Those results indicated that about 75 percent of the carotenoids found in the flower of the transformed plant contained a keto group.

Thus, it would be advantageous if an algae, plant or other microorganism were available which produce large amounts ferulic acid or sinapic acid. The invention discussed hereinafter relates in some embodiments to such transformed prokaryotic or eukaryotic microorganisms.

It would also be advantageous if plants were available whose roots, leaves, stem, fruits or flowers produced large amounts of ferulic acid or sinapic acid. The invention discussed hereinafter relates in some embodiments to such transformed plants.

Therefore improving the quality of foodstuffs and animal feeds is an important task of the food-and-feed industry. This is necessary since, for example ferulic acid or sinapic acid, as mentioned above, which occur in plants and some microorganisms are limited with regard to the supply of mammals. Especially advantageous for the quality of foodstuffs and animal feeds is as balanced as possible a specific ferulic acid or sinapic acid profile in the diet since an excess of ferulic acid or sinapic acid above a specific concentration in the food has a positive effect. A further increase in quality is only possible via addition of further ferulic acid or sinapic acid, which are limiting.

To ensure a high quality of foods and animal feeds, it is therefore necessary to add ferulic acid or sinapic acid in a balanced manner to suit the organism.

Accordingly, there is still a great demand for new and more suitable genes which encode enzymes or other proteins which participate in the biosynthesis of ferulic acid or sinapic acid and make it possible to produce them specifically on an industrial scale without unwanted byproducts forming. In the selection of genes for biosynthesis two characteristics above all are particularly important. On the one hand, there is as ever a need for improved processes for obtaining the highest possible contents of ferulic acid or sinapic acid; on the other hand as less as possible byproducts should be produced in the production process.

It was now found that this object is achieved by providing the process according to the invention described herein and the embodiments characterized in the claims.

Accordingly, in a first embodiment, the invention relates to a process for the production of a fine chemical, whereby the fine chemical is a ferulic acid or sinapic acid. Accordingly, in the present invention, the term "the fine chemical" as used herein relates to a ferulic acid or sinapic acid. Further, the term "the fine chemicals" as used herein also relates to fine chemicals comprising ferulic acid or sinapic acid.

In one embodiment, the term "the fine chemical" or "the respective fine chemical" means at least one chemical compound with ferulic acid or sinapic acid activity.

In one embodiment, the term "the fine chemical" means ferulic acid. In one embodiment, the term "the fine chemical" means sinapic acid depending on the context in which the term is used. Throughout the specification the term "the fine chemical" means ferulic acid or sinapic acid, its salts, ester, thioester or in free form or bound to other compounds such sugars or sugarpolymers, like glucoside, e.g. diglucoside.

Accordingly, the present invention relates to a process comprising
(a) increasing or generating the activity of one or more b0196, b0730, b1896, b2414, b3074, b3172, YBR184W, YDR513W or b2818 protein(s) in a non-human organism in one or more parts thereof; and
(b) growing the organism under conditions which permit the production of the fine chemical, thus ferulic acid or sinapic acid in said organism.

Accordingly, the present invention relates to a process comprising.
(a) increasing or generating the activity of one or more proteins having the activity of a protein indicated in Table II, column 3, lines 243 to 250 and 603, resp. or having the sequence of a polypeptide encoded by a nucleic acid molecule indicated in Table I, column 5 or 7, lines 243 to 250 and 603, resp. in a non-human organism in one or more parts thereof; and
growing the organism under conditions which permit the production of the fine chemical, thus, ferulic acid or sinapic acid, in said organism.

Accordingly, the term "the fine chemical" means "ferulic acid" in relation to all sequences listed in Table I, lines 243, 244, 246, 247, 249 or homologs thereof and means "sinapic acid" in relation to the sequence listed in Table I, lines 245, 248, 250, 603 or homologs thereof. Accordingly, the term "the fine chemical" can mean "ferulic acid" or "sinapic acid", owing to circumstances and the context. In order to illustrate that the meaning of the term "the respective fine chemical" means "ferulic acid" or "sinapic acid" owing to the sequences listed in the context the term "the respective fine chemical" is also used.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

The term "Table I" used in this specification is to be taken to specify the content of Table I A and Table I B. The term "Table II" used in this specification is to be taken to specify the content of Table II A and Table II B. The term "Table I A" used in this specification is to be taken to specify the content of Table I A. The term "Table I B" used in this specification is to be taken to specify the content of Table I B. The term "Table II A" used in this specification is to be taken to specify the content of Table II A. The term "Table II B" used in this specification is to be taken to specify the content of Table II B. In one preferred embodiment, the term "Table I" means Table I B. In one preferred embodiment, the term "Table II" means Table II B.

Preferably, this process further comprises the step of recovering the fine chemical, which is synthesized by the organism from the organism and/or from the culture medium used for the growth or maintenance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99%.

Advantageously the process for the production of the respective fine chemical leads to an enhanced production of the respective fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the respective fine chemical in comparison to the reference as defined below, e.g. that means in comparison to an organism without the aforementioned modification of the activity of a protein having the activity of a protein indicated in Table II, column 3, lines 243 to 250 and 603 or encoded by nucleic acid molecule indicated in Table I, columns 5 or 7, lines 243 to 250 and 603.

Surprisingly it was found, that the transgenic expression of the *Escherichia coli* K12 protein b0196, b0730, b1896, b2414, b3074, b3172, b2818 or *Saccharomyces cerevisiae* protein YBR184W or YDR513W in *Arabidopsis thaliana* conferred an increase in ferulic acid or sinapic acid ("the fine chemical" or "the fine respective chemical") in respect to said proteins and their homologs as wells as the encoding nucleic acid molecules, in particular as indicated in Table II, column 3, lines 243 to 250 and 603 content of the transformed plants.

In accordance with the invention, the term "organism" as understood herein relates always to a non-human organism, in particular to an animal or plant organism or to a microorganism. Further, the term "animal" as understood herein relates always to a non-human animal.

In accordance with the invention it is known to the skilled that anionic compounds such as acids are present in aqueous solutions in an equilibrium between the acid and its salts according to the pH present in the respective compartment of the cell or organism and the pK of the acid. Depending on the strength of the acid (pK) and the pH the salt or the free acid are predominant. Thus, the term "the fine chemical", the term "the respective fine chemical", or the term "acid" or the use of a denomination referring to a neutralized anionic compound relates to the anionic form as well as the neutralised status of that compound according to the milieu of the aqueous solution in which they are present.

The sequence of b0196 from *Escherichia coli* K12 has been published in Blattner, F. R. et al., Science 277 (5331), 1453-1474 (1997) and its activity is being defined as regulator in colanic acid synthesis. Accordingly, in one embodiment, the process of the present invention comprises the use of a protein b0196 from *Escherichia coli* K12 or its homolog, e.g. as shown herein, for the production of the respective fine chemical, in particular for increasing the amount of ferulic acid, preferably in free or bound form in an organism or a part thereof, as mentioned. In one embodiment, in the process of the present invention the activity of the protein b0196 is increased.

The sequence of b0730 from *Escherichia coli* K12 has been published in Blattner F. R. et al., Science 277:1453-1474 (1997) and its activity is being defined as a transcriptional regulator of succinyl Co Asynthase operon and fatty acyl responsive regulator. Accordingly, in one embodiment, the process of the present invention comprises the use of a protein b0730 from *Escherichia coli* K12 or its homolog, e.g. as shown herein, for the production of the respective fine chemical, in particular for increasing the amount of ferulic acid, preferably in free or bound form in an organism or a part thereof, as mentioned. In one embodiment, in the process of the present invention the activity of the protein b0730 is increased.

The sequence of b1896 from *Escherichia coli* K12 has been published in Blattner F. R. et al., Science 277:1453-1474 (1997) and its activity is being defined as a protein having trehalose-6-phosphate synthase activity. Accordingly, in one embodiment, the process of the present invention comprises the use of a protein b1896 from *Escherichia coli* K12 or its homolog, e.g. as shown herein, for the production of the respective fine chemical, in particular for increasing the amount of sinapic acid, preferably in free or bound form in an organism or a part thereof, as mentioned. In one embodiment, in the process of the present invention the activity of the protein b1896 is increased.

The sequence of b2414 from *Escherichia coli* K12 has been published in Blattner F. R. et al., Science 277:1453-1474 (1997) and its function is being defined as a subunit of cysteine synthase A and O-acetylserine sulfhydrolase A, a PLP-dependent enzyme. Accordingly, in one embodiment, the process of the present invention comprises the use of a protein b2414 from *Escherichia coli* K12 or its homolog, e.g. as shown herein, for the production of the respective fine chemical, in particular for increasing the amount of ferulic acid, preferably in free or bound form in an organism or a part thereof, as mentioned. In one embodiment, in the process of the present invention the activity of the protein b2414 is increased.

The sequence of b3074 from *Escherichia coli* K12 has been published in Blattner F. R. et al., Science 277:1453-1474 (1997) and its activity is being defined as a putative tRNA synthetase protein. Accordingly, in one embodiment, the process of the present invention comprises the use of a protein b3074 from *Escherichia coli* K12 or its homolog, e.g. as shown herein, for the production of the respective fine chemical, in particular for increasing the amount of ferulic acid, preferably in free or bound form in an organism or a part thereof, as mentioned. In one embodiment, in the process of the present invention the activity of the protein b3074 is increased.

The sequence of b3172 from *Escherichia coli* K12 has been published in Blattner F. R. et al., Science 277:1453-1474 (1997) and its activity is being defined as a protein having argininosuccinate synthetase activity. Accordingly, in one embodiment, the process of the present invention comprises the use of a protein b3172 from *Escherichia coli* K12 or its homolog, e.g. as shown herein, for the production of the respective fine chemical, in particular for increasing the amount of sinapic acid, preferably in free or bound form in an organism or a part thereof, as mentioned. In one embodiment, in the process of the present invention the activity of the protein b3172 is increased.

The sequence of YBR184W from *Saccharomyces cerevisiae* has been published in Goffeau, A. et al., Science 274 (5287), 546-547 (1996) and its activity is being defined as an unclassified protein. Accordingly, in one embodiment, the process of the present invention comprises the use of a protein YBR184W from *Saccharomyces cerevisiae* or its homolog, e.g. as shown herein, for the production of the respective fine chemical, in particular for increasing the amount of ferulic acid, preferably in free or bound form in an organism or a part thereof, as mentioned. In one embodiment, in the process of the present invention the activity of the unspecified protein YBR184W is increased.

The sequence of YDR513W from *Saccharomyces cerevisiae* has been published in Jacq, C. et al., Nature 387 (6632 Suppl), 75-78 (1997) and its activity is being defined as a protein having glutaredoxin (thioltransferase) (glutathione reductase) activity. Accordingly, in one embodiment, the process of the present invention comprises the use of a protein YDR513W having said activity, for the production of the respective fine chemical, in particular for increasing the amount of sinapic acid, preferably in free or bound form in an organism or a part thereof, as mentioned. In one embodiment, in the process of the present invention the activity of the protein YDR513W is increased. The sequence of b2818 (Accession number NP_417295) from *Escherichia coli* K12 has been published in Blattner et al., Science 277 (5331), 1453-1474, 1997, and its activity is being defined as a N-acetylglutamate synthase (amino acid N-acetyltransferase). Accordingly, in one embodiment, the process of the present invention comprises the use of a gene product with an activity of amino-acid acetyltransferase, acetylglutamate kinase superfamily, preferably a protein with the activity of a a N-acetylglutamate synthase (amino acid N-acetyltransferase) from *E. coli* or its homolog, e.g. as shown herein, for the production of the fine chemical, meaning of sinapic acid, in particular for increasing the amount of sinapic acid, preferably sinapic acid in free or bound form in an organism or a part thereof, as mentioned.

Homologues (=homologs) of the present gene products can be derived from any organisms as long as the homologue confers the herein mentioned activity, in particular, confers an increase in the respective fine chemical amount or content.

In one embodiment, the homolog of any one of the polypeptides indicated in Table II, column 3, lines 243, 244, 246, 247 or 249 is a homolog having the same or a similar activity. In particular an increase of activity confers an increase in the content of the respective fine chemical in the organisms preferably ferulic acid.

In one embodiment, the homolog of the polypeptides indicated in Table II, column 3, line 245, 248, 250 or 603 is a homolog having the same or a similar activity. In particular an increase of activity confers an increase in the content of the respective fine chemical in the organisms preferably sinapic acid.

Homologs of the polypeptides indicated in Table II, column 3, lines 243 to 248, 250 and 603 may be the polypeptides encoded by the nucleic acid molecules indicated in Table I, column 7, lines 243 to 248, 250 and 603 or may be the polypeptides indicated in Table II, column 7, lines 243 to 248, 250 and 603.

Homologs of the polypeptides indicated in Table II, column 3, lines 243, 244, 246, 247 may be the polypeptides encoded by the nucleic acid molecules indicated in Table I, column 7, lines 243, 244, 246, 247, respectively or may be the polypeptides indicated in Table II, column 7, lines 243, 244, 246, 247, having a ferulic acid content and/or amount increasing activity.

Homologs of the polypeptide indicated in Table II, column 3, lines 245, 248, 250, 603 may be the polypeptides encoded by the nucleic acid molecules indicated in Table I, column 7, lines 245, 248, 250, 603 respectively or may be the polypeptides indicated in Table II, column 7, lines 245, 248, 250, 603 having a sinapic acid content and/or amount increasing activity.

Homologs of the polypeptides polypeptide indicated in Table II, column 3, lines 243 to 250 and 603 may be the polypetides encoded by the nucleic acid molecules polypeptide indicated in Table I, column 7, lines 243 to 250 and 603 or may be the polypeptides indicated in Table II, column 7, lines 243 to 250 and 603.

Further homologs of are described herein below.

In accordance with the invention, a protein or polypeptide has the "activity of a protein of the invention", e.g. the activity of a protein indicated in Table II, column 3, lines 243 to 250 and 603 if its de novo activity, or its increased expression directly or indirectly leads to an increased ferulic acid or sinapic acid level, resp., in the organism or a part thereof, preferably in a cell of said organism. In a preferred embodiment, the protein or polypeptide has the above-mentioned additional activities of a protein indicated in Table II, column 3, lines 243 to 250 and 603. Throughout the specification the activity or preferably the biological activity of such a protein or polypeptide or an nucleic acid molecule or sequence encoding such protein or polypeptide is identical or similar if it still has the biological or enzymatic activity of any one of the proteins indicated in Table II, column 3, lines 243 to 250 and 603, or which has at least 10% of the original enzymatic activity, preferably 20%, particularly preferably 30%, most particularly preferably 40% in comparison to any one of the proteins indicated in Table II, column 3, lines 243 to 250 and 603 of *Escherichia coli* K12 or *Saccharomyces cerevisiae* respectively.

In one embodiment, the polypeptide of the invention confers said activity, e.g. the increase of the respective fine chemical in an organism or a part thereof, if it is derived from an organism, which is evolutionary close to the organism indicated in Table I, column 4 and is expressed in an organism, which is evolutionary distant to the origin organism. For example origin and expressing organism are derived from different families, orders, classes or phylums whereas origin and the organism indicated in Table I, column 4 are derived from the same families, orders, classes or phylums.

In one embodiment, the polypeptide of the invention or the polypeptide used in the method of the invention confers said activity, e.g. the increase of the fine chemical in an organism or a part thereof, if it is derived from an organism, which is evolutionary distant to the organism in which it is expressed. For example origin and expressing organism are derived from different families, orders, classes or phylums.

In one embodiment, the polypeptide of the invention or the polypeptide used in the method of the invention confers said activity, e.g. the increase of the fine chemical in an organism or a part thereof, if it is derived from an organism, which is evolutionary close to the organism indicated in Table I, column 4 and is expressed in an organism, which is evolutionary distant to the origin organism. For example origin and expressing organism are derived from different families, orders, classes or phylums whereas origin and the organism indicated in Table I, column 4 are derived from the same families, orders, classes or phylums.

The terms "increased", "rose", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change or the modulation of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild type cell. However, the terms increase or decrease as used herein also include the change or modulation of a property in the whole organism as mentioned.

Accordingly, the term "increase" or "decrease" means that the specific activity of an enzyme, preferably the amount of a compound or metabolite, e.g. of a polypeptide, a nucleic acid molecule or of the respective fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control, or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control, or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99, 999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention. E.g., it differs by or in the expression level or activity of an protein having the activity of a protein as indicated in Table II, column 3, lines 243 to 250 and 603 or being encoded by a nucleic acid molecule indicated in Table I, column 5, lines 243 to 250 and 603 or its homologs, e.g. as indicated in Table I, column 7, lines 243 to 250 and 603, its biochemical or genetic causes. It therefore shows the increased amount of the respective fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or Protein or activity or expression of reference genes, like housekeeping genes, such as ubiquitin, actin or ribosomal proteins.

A series of mechanisms exists via which a modification of a protein, e.g. the polypeptide of the invention or the polypeptide used in the method of the invention can directly or indirectly affect the yield, production and/or production efficiency of the fine chemical.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by amplifying the number of gene(s), by modifying the regulation of the gene, or by increasing the stability of the corresponding mRNA or of the corresponding gene product encoded by the nucleic acid molecule of the invention or the nucleic acid molecule used in the method of the invention, or by introducing homologous genes from other organisms which are differently regulated, e.g. not feedback sensitive.

This also applies analogously to the combined increased expression of the nucleic acid molecule of the present invention or its gene product with that of further enzymes or regulators of the biosynthesis pathways of the respective fine chemical, e.g. which are useful for the synthesis of the respective fine chemicals.

The increase, decrease or modulation according to this invention can be constitutive, e.g. due to a stable permanent transgenic expression or to a stable mutation in the corresponding endogenous gene encoding the nucleic acid molecule of the invention or the nucleic acid molecule used in the method of the invention or to a modulation of the expression or of the behaviour of a gene conferring the expression of the polypeptide of the invention or the polypeptide used in the method of the invention, or transient, e.g. due to an transient transformation or temporary addition of a modulator such as a agonist or antagonist or inducible, e.g. after transformation with a inducible construct carrying the nucleic acid molecule of the invention or the nucleic acid molecule used in the method of the invention under control of a inducible promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the respective fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In case the activity of the *Escherichia coli* K12 protein b0196 or its homologs, e.g. as indicated in Table II, columns 5 or 7, line 243 is increased, in one embodiment the increase of the respective fine chemical, preferably of ferulic acid between 10% and 25% or more is conferred.

In one embodiment, in case the activity of the *Escherichia coli* K12 protein b0730 or its homologs, e.g. as indicated in Table II, columns 5 or 7, line 244 is increased, preferably, in one embodiment the increase of the respective fine chemical, preferably of ferulic acid between 38% and 97% or more is conferred.

In one embodiment, in case the activity of the *Escherichia coli* K12 protein b1896 or its homologs, e.g. as indicated in Table II, columns 5 or 7, line 245 is increased, preferably, in one embodiment the increase of the respective fine chemical, preferably of sinapic acid between 38% and 98% or more is conferred.

In one embodiment, in case the activity of the *Escherichia coli* K12 protein b2414 or its homologs, e.g. as indicated in Table II, columns 5 or 7, line 246 is increased, preferably, in one embodiment the increase of the respective fine chemical, preferably of ferulic acid between 34% and 86% or more is conferred.

In one embodiment, in case the activity of the *Escherichia coli* K12 protein b3074 or its homologs, e.g. as indicated in Table II, columns 5 or 7, line 247 is increased, preferably, in one embodiment the increase of the respective fine chemical, preferably of ferulic acid between 35% and 73% or more is conferred.

In one embodiment, in case the activity of the *Escherichia coli* K12 protein b3172 or its homologs, e.g. as indicated in Table II, columns 5 or 7, line 248 is increased, preferably, in one embodiment the increase of the respective fine chemical, preferably of sinapic acid between 31% and 89% or more is conferred.

In one embodiment, in case the activity of the *Saccharomyces cerevisae* protein YBR184W or its homologs as indicated in Table II, columns 5 or 7, line 249, is increased, preferably, in one embodiment the increase of the respective fine chemical, preferably of ferulic acid between 30% and 37% or more is conferred.

In one embodiment, in case the activity of the *Saccharomyces cerevisiae* protein YDR513W or its homologsas indicated in Table II, columns 5 or 7, line 250, is increased, preferably, in one embodiment an increase of the respective fine chemical, preferably of sinapic acid between 30% and 39% or more is conferred.

In one embodiment, in case the activity of the *Escherichia coli* K12 protein b2818 or its homologs, e.g. as indicated in Table II, columns 5 or 7, line 603 is increased, preferably, in one embodiment the increase of the respective fine chemical, preferably of sinapic acid between 27% and 54% or more is conferred.

In one embodiment, in case the activity of the *Escherichia coli* K12 protein b0196 or its homologs, e.g. a regulator in colanic acid synthesis is increased, preferably an increase of the fine chemical ferulic acid is conferred.

In one embodiment, in case the activity of the *Escherichia coli* K12 protein b0730 or its homologs, e.g. a transcriptional regulator of succinylCoA synthetase operon and fatty acyl response regulator increased, preferably an increase of the fine chemical ferulic acid is conferred.

In one embodiment, in case the activity of the *Escherichia coli* K12 protein b1896 or its homologs, e.g. a trehalose-6-phosphate synthase 5 is increased, preferably an increase of the fine chemical sinapic acid is conferred.

In one embodiment, in case the activity of the *Escherichia coli* K12 protein b2414 or its homologs, e.g. a subunit of cysteine synthase A and O-acetylserine sulfhydrolase A, PLP-dependent enzyme is increased, preferably an increase of the fine chemical ferulic acid is conferred.

In one embodiment, in case the activity of the *Escherichia coli* K12 protein b3074 or its homologs, e.g. a putative tRNA synthetase is increased, preferably an increase of the fine chemical ferulic acid is conferred.

In one embodiment, in case the activity of the *Escherichia coli* K12 protein b3172 or its homologs, e.g. a protein having argininosuccinate synthetase activity is increased, preferably an increase of the fine chemical sinapic acid is conferred.

In one embodiment, in case the activity of the *Saccharomyces cerevisae* protein YBR184W or its homologs is increased, preferably an increase of the fine chemical ferulic acid is conferred.

In one embodiment, in case the activity of the *Saccharomyces cerevisiae* protein YDR513W or its homologs is increased, preferably an increase of the fine chemical sinapic acid is conferred.

In one embodiment, in case the activity of the *Escherichia coli* K12 protein b2818 or its homologs, e.g. a N-acetylglutamate synthase (amino acid N-acetyltransferase) is increased, preferably, in one embodiment the increase of the respective fine chemical, preferably an increase of the fine chemical sinapic acid is conferred.

In this context, the respective fine chemical amount in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

The respective fine chemical can be contained in the organism either in its free form and/or bound to proteins or polypeptides or mixtures thereof. Accordingly, in one embodiment, the amount of the free form in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%. Accordingly, in an other embodiment, the amount of the bound the respective fine chemical in a cell, preferably in a tissue, more preferred in a organism as a plant or a microorganism or part thereof, is increased by 3% or more, especially preferably are 10% or more, very especially preferably are more than 30% and most preferably are 70% or more, such as 100%, 300% or 500%.

A protein having an activity conferring an increase in the amount or level of the respective fine chemical ferulic acid preferably has the structure of the polypeptide described herein. In a particular embodiment, the polypeptides used in the process of the present invention or the polypeptide of the present invention comprises the sequence of a consensus sequence as indicated in Table IV, columns 7, lines 243, 244, 246, 247 or of a polypeptide as indicated in Table II, columns 5 or 7, lines 243, 244, 246, 247 and/or 249 or of a functional homologue thereof as described herein, or of a polypeptide encoded by the nucleic acid molecule characterized herein or the nucleic acid molecule according to the invention, for example by a nucleic acid molecule as indicated in Table I, columns 5 or 7, lines 243, 244, 246, 247 and/or 249 or its herein described functional homologues and has the herein mentioned activity conferring an increase in the ferulic acid level.

A protein having an activity conferring an increase in the amount or level of the sinapic preferably has the structure of the polypeptide described herein. In a particular embodiment, the polypeptides used in the process of the present invention or the polypeptide of the present invention comprises the sequence of a consensus sequence as indicated in Table IV, column 7, line 245, 248, 250 and/or 603 or of a polypeptide as indicated in Table II, columns 5 or 7, line 245, 248, 250 and/or 603 or of a functional homologue thereof as described herein, or of a polypeptide encoded by the nucleic acid molecule characterized herein or the nucleic acid molecule according to the invention, for example by a nucleic acid molecule as indicated in Table I, columns 5 or 7, line 245, 248, 250 and/or 603 or its herein described functional homologues and has the herein mentioned activity confering an increase in the sinapic level.

For the purposes of the present invention, the term "the respective fine chemical" also encompass the corresponding salts, such as, for example, the potassium or sodium salts of ferulic acid or sinapic acid, resp., or their ester, or glucoside thereof, e.g the diglucoside thereof.

Owing to the biological activity of the proteins which are used in the process according to the invention and which are encoded by nucleic acid molecules according to the invention, it is possible to produce compositions comprising the respective fine chemical, i.e. an increased amount of the free chemical free or bound, e.g compositions comprising ferulic acid or sinapic acid. Depending on the choice of the organism used for the process according to the present invention, for example a microorganism or a plant, compositions or mixtures of ferulic acid or sinapic acid can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps a) stabilizing a protein conferring the increased expression of a protein encoded by the nucleic acid molecule of the invention or of the polypeptide of the invention, e.g. of a polypeptide having an activity of a protein as indicated in Table II, column 3, lines 243 to 250 and 603 or its homologs, e.g. as indicated in Table II, columns 5 or 7, lines 243 to 250 and 603, activity having herein-mentioned the respective fine chemical increasing activity;

b) stabilizing a mRNA conferring the increased expression of a protein encoded by the nucleic acid molecule of the invention, e.g. of a polypeptide having an activity of a protein as indicated in Table II, column 3, lines 243 to 250 and 603 or its homologs activity, e.g. as indicated in Table II, columns 5 or 7, lines 243 to 250 and 603, or of a mRNA encoding the polypeptide of the present invention having herein-mentioned the respective fine chemical increasing activity;

c) increasing the specific activity of a protein conferring the increased expression of a protein encoded by the nucleic acid molecule of the invention or of the polypeptide of the present invention having herein-mentioned the respective fine chemical increasing activity, e.g. of a polypeptide having an activity of a protein as indicated in Table II, column 3, lines 243 to 250 and 603 or its homologs activity, e.g. as indicated in Table II, columns 5 or 7, lines 243 to 250 and 603, or decreasing the inhibitory regulation of the polypeptide of the invention;

d) generating or increasing the expression of an endogenous or artificial transcription factor mediating the expression of a protein conferring the increased expression of a protein encoded by the nucleic acid molecule of the invention or of the polypeptide of the invention having herein-mentioned the respective fine chemical increasing activity, e.g. of a polypeptide having an activity of a protein as indicated in Table II, column 3, lines 243 to 250 and 603 or its homologs activity, e.g. as indicated in Table II, columns 5 or 7, lines 243 to 250 and 603;

e) stimulating activity of a protein conferring the increased expression of a protein encoded by the nucleic acid molecule of the present invention or a polypeptide of the present invention having herein-mentioned the respective fine chemical increasing activity, e.g. of a polypeptide having an activity of a protein as indicated in Table II, column 3, lines 243 to 250 and 603 or its homologs activity, e.g. as indicated in Table II, columns 5 or 7, lines 243 to 250 and 603, by adding one or more exogenous inducing factors to the organism or parts thereof;

f) expressing a transgenic gene encoding a protein conferring the increased expression of a polypeptide encoded by the nucleic acid molecule of the present invention or a polypeptide of the present invention, having herein-mentioned the respective fine chemical increasing activity, e.g. of a polypeptide having an activity of a protein as indicated in Table II, column 3, lines 243 to 250 and 603 or its homologs activity, e.g. as indicated in Table II, columns 5 or 7, lines 243 to 250 and 603, and/or g) increasing the copy number of a gene conferring the increased expression of a nucleic acid molecule encoding a polypeptide encoded by the nucleic acid molecule of the invention or the polypeptide of the invention having herein-mentioned the respective fine chemical increasing activity, e.g. of a polypeptide having an activity of a protein as indicated in Table II, column 3, lines 243 to 250 and 603 or its homologs, e.g. as indicated in Table II, columns 5 or 7, lines 243 to 250 and 603, activity.

h) Increasing the expression of the endogenous gene encoding the polypeptide of the invention, e.g. a polypeptide having an activity of a protein as indicated in Table II, column 3, lines 243 to 250 and 603 or its homologs activity, e.g. as indicated in Table II, columns 5 or 7, lines 243 to 250 and 603, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements. Positive elements can be randomly introduced in plants by T-DNA or transposon mutagenesis and lines can be identified in which the positive elements have be integrated near to a gene of the invention, the expression of which is thereby enhanced; and/or i) Modulating growth conditions of an organism in such a manner, that the expression or activity of the gene encoding the protein of the invention or the protein itself is enhanced for example microorganisms or plants can be grown for example under a higher temperature regime leading to an enhanced expression of heat shock proteins, which can lead to an enhanced respective fine chemical production.

j) selecting of organisms with especially high activity of the proteins of the invention from natural or from mutagenized resources and breeding them into the target organisms, e.g. the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring the increase of the respective fine chemical after increasing the expression or activity of the encoded polypeptide or having the activity of a polypeptide having an activity of a protein as indicated in Table II, columns 3 or 5, lines 243 to 250 and 603, resp., or its homologs activity, e.g. as indicated in Table II, columns 5 or 7, lines 243 to 250 and 603, resp.

In general, the amount of mRNA or polypeptide in a cell or a compartment of a organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in Textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention or the polypeptide used in the method of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell, or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, a organ, an organelle etc., is achieved by increasing the endogenous level of the polypeptide of the invention or the polypeptide used in the method of the invention. Accordingly, in an embodiment of the present invention, the present invention relates to a process wherein the gene copy number of a gene encoding the polynucleotide or nucleic acid molecule of the invention or the nucleic acid molecule used in the method of the invention as herein described is increased. Further, the endogenous level of the polypeptide of the invention or the polypeptide used in the method of the invention as described can for example be increased by modifying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others citied therein. Reverse genetic strategies to identify insertions (which eventually carrying the activation elements) near in genes of interest have been described for various cases e.g. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (e.g. T-DNA or Transposon) and the gene of interest.

Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is disrupted by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as tilling (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, of the polypeptide of the invention or the polypeptide used in the method of the invention, e.g. conferring the increase of the respective fine chemical after increase of expression or activity can also be increased by introducing a synthetic transcription factor, which binds close to the coding region of an endogenous polypeptide of the invention or the polypeptide used in the method of the invention- or used in the process of the invention or its endogenous homolog-encoding gene and the synthetic transcription factor activates its transcription. A chimeric zinc finger protein can be construed, which comprises a specific DNA-binding domain and an activation domain as e.g. the VP16 domain of Herpes Simplex virus. The specific binding domain can bind to the regulatory region of the endogenous protein coding region. The expression of the chimeric transcription factor in a organism, in particular in a plant, leads to a specific expression of an endogenous polypeptide of the invention or used in the process of the invention, in particular a plant homolog thereof, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It is therefore advantageously to express in an organism a nucleic acid molecule of the invention or the nucleic acid molecule used in the method of the invention or a polypeptide of the invention or the polypeptide used in the method of the invention derived from a evolutionary distantly related organism, as e.g. using a prokaryotic gene in an eukaryotic host, as in these cases the regulation mechanism of the host cell may not weaken the activity (cellular or specific) of the gene or its expression product The mutation is introduced in such a way that the production of ferulic acid or sinapic acid is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an increased productivity of the desired respective fine chemical(s).

Owing to the introduction of a gene or a plurality of genes conferring the expression of the nucleic acid molecule of the invention or the polypeptide of the invention, for example the nucleic acid construct mentioned below, or encoding a protein of the invention into an organism alone or in combination with other genes, it is possible not only to increase the biosynthetic flux towards the end product, but also to increase, modify or create de novo an advantageous, preferably novel metabolite composition in the organism, e.g. an advantageous composition of ferulic acid and sinapic acid or their biochemical derivatives, e.g. comprising a higher content of (from a viewpoint of nutritional physiology limited) ferulic acid and/or sinapic acid or their derivatives.

Preferably the composition further comprises higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including amino acids or its precursors, required for the cell's biosynthesis of amino acids may be increased so that the concentration of necessary or relevant precursors, cofactors or intermediates within the cell(s) or within the corresponding storage compartments is increased. Owing to the increased or novel generated activity of the polypeptide of the invention or the polypeptide used in the method of the invention or owing to the increased number of nucleic acid sequences of the invention and/or to the modulation of further genes which are involved in the biosynthesis of the amino acids, e.g. by increasing the activity of enzymes synthesizing precursors or by destroying the activity of one or more genes which are involved in the breakdown of the amino acids, it is possible to increase the yield, production and/or production efficiency of amino acids in the host organism, such as the plants or the microorganisms.

Accordingly, in one embodiment, the process according to the invention relates to a process, which comprises:
(a) providing a non-human organism, preferably a microorganism, a non-human animal, a plant or animal cell, a plant or animal tissue or a plant;
(b) increasing an activity of a polypeptide of the invention or a homolog thereof, e.g. as indicated in Table II, columns 5 or 7, lines 243 to 250 and 603, or of a polypeptide being encoded by the nucleic acid molecule of the present invention and described below, e.g. conferring an increase of the respective fine chemical in an organism, preferably in a microorganism, a non-human animal, a plant or animal cell, a plant or animal tissue or a plant,
(c) growing an organism, preferably a microorganism, a non-human animal, a plant or animal cell, a plant or animal tissue or a plant under conditions which permit the production of the respective fine chemical in the organism, preferably the microorganism, the plant cell, the plant tissue or the plant; and
(d) if desired, recovering, optionally isolating, the free and/or bound the respective fine chemical synthesized by the organism, the microorganism, the non-human animal, the plant or animal cell, the plant or animal tissue or the plant.

The organism, in particular the microorganism, non-human animal, the plant or animal cell, the plant or animal tissue or the plant is advantageously grown in such a way that it is not only possible to recover, if desired isolate the free or bound respective fine chemical.

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the respective fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the respective fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae Tuberculariaceae, Adelotheciaceae, Dinophyceae, Ditrichaceae or Prasinophyceae, or a prokaryotic organism, for example a bacterium or blue alga, in particular a bacterium from the families Actinomycetaceae, Bacillaceae, Brevibacteriaceae, Corynebacteriaceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The organism such as microorganisms or plants or the recovered, and if desired isolated, the respective fine chemical can then be processed further directly into foodstuffs or animal feeds or for other applications. The fermentation broth, fermentation products, plants or plant products can be purified with methods known to the person skilled in the art.

Products of these different work-up procedures are ferulic acid or sinapic acid or comprising compositions of ferulic acid and sinapic acid still comprising fermentation broth, plant particles and cell components in different amounts, advantageously in the range of from 0 to 99% by weight, preferably below 80% by weight, especially preferably below 50% by weight.

Preferred microorganisms are selected from the group consisting of Chaetomiaceae such as the genera *Chaetomium* e.g. the species *Chaetomidium fimeti*; Choanephoraceae such as the genera *Blakeslea*, *Choanephora* e.g. the species *Blakeslea trispora*, *Choanephora cucurbitarum* or *Choanephora infundibulifera* var. *cucurbitarum*; Cryptococcaceae such as the genera *Candida*, *Crytococcus*, *Rhodotorula*, *Torulopsis* e.g. the species *Candida albicans*, *Candida albomarginata*, *Candida antarctica*, *Candida bacarum*, *Candida bogoriensis*, *Candida boidinii*, *Candida bovina*, *Candida brumptii*, *Candida cacaoi*, *Candida cariosilignicola*, *Candida catenulata*, *Candida chalmersii*, *Candida ciferrii*, *Candida cylindracea*, *Candida edax*, *Candida ernobii*, *Candida famata*, *Candida freyschussii*, *Candida friedrichii*, *Candida glabrata*, *Candida guiffiermondii*, *Candida haemulonii*, *Candida humicola*, *Candida inconspicua*, *Candida ingens*, *Candida intermedia*, *Candida kefyr*, *Candida krusei*, *Candida lactiscondensi*, *Candida lambica*, *Candida lipolytica*, *Candida lusitaniae*, *Candida macedoniensis*, *Candida magnoliae*, *Candida membranaefaciens*, *Candida mesenterica*, *Candida multigemmis*, *Candida mycoderma*, *Candida nemodendra*, *Candida nitratophila*, *Candida norvegensis*, *Candida norvegica*, *Candida parapsilosis*, *Candida pelliculosa*, *Candida peltata*, *Candida pini*, *Candida pseudotropicalis*, *Candida pulcherrima*, *Candida punicea*, *Candida pustula*, *Candida ravautii*, *Candida reukaufii*, *Candida rugosa*, *Candida sake*, *Candida silvicola*, *Candida solani*, *Candida* sp., *Candida spandovensis*, *Candida succiphila*, *Candida tropicalis*, *Candida utilis*, *Candida valida*, *Candida versatilis*, *Candida vini*, *Candida zeylanoides*, *Cryptococcus albidus*, *Cryptococcus curvatus*, *Cryptococcus flavus*, *Cryptococcus humicola*, *Cryptococcus hungaricus*, *Cryptococcus kuetzingii*, *Cryptococcus laurentii*, *Cryptococcus macerans*, *Cryptococcus neoformans*, *Cryptococcus terreus*, *Cryptococcus uniguttulatus*, *Rhodotorula acheniorum*, *Rhodotorula bacarum*, *Rhodotorula bogoriensis*, *Rhodotorula flava*, *Rhodotorula glutinis*, *Rhodotorula macerans*, *Rhodotorula minuta*, *Rhodotorula mucilaginosa*, *Rhodotorula pilimanae*, *Rhodotorula pustula*, *Rhodotorula rubra*, *Rhodotorula tokyoensis*, *Torulopsis colliculosa*, *Torulopsis dattila* or *Torulopsis neoformans*; Cunninghamellaceae such as the genera *Cunninghamella* e.g. the species *Cunninghamella blakesleeana*, *Cunninghamella echinulata*, *Cunninghamella echinulata* var. *elegans*, *Cunninghamella elegans* or *Cunninghamella homothaffica*; Demetiaceae such as the genera *Alternaria*, *Bipolaris*, *Cercospora*, *Chalara*, *Cladosporium*, *Curvularia*, *Exophilia*, *Helicosporium*, *Helminthosporium*, *Orbimyces*, *Philalophora*, *Pithomyces*, *Spilocaea*, *Thielaviopsis*, *Wangiella* e.g. the species *Curvularia affinis*, *Curvularia clavata*, *Curvularia fallax*, *Curvularia inaequalis*, *Curvularia indica*, *Curvularia lunata*, *Curvularia pallescens*, *Curvularia verruculosa* or *Helminothosporium* sp.; Moniliaceae such as the genera *Arthrobotrys*, *Aspergillus*, *Epidermophyton*, *Geotrichum*, *Gliocladium*, *Histoplasma*, *Microsporum*, *Monilia*, *Oedocephalum*, *Oidium*, *Penicillium*, *Trichoderma*, *Trichophyton*, *Thrichoteclum*, *Verticillium* e.g. the species *Aspergillus aculeatus*, *Aspergillus albus*, *Aspergillus alliaceus*, *Aspergillus asperescens*, *Aspergillus awamori*, *Aspergillus candidus*, *Aspergillus carbonarius*, *Aspergillus carneus*, *Aspergillus chevalieri*, *Aspergillus chevalieri* var. *intermedius*, *Aspergillus clavatus*, *Aspergillus ficuum*, *Aspergillus flavipes*, *Aspergillus flavus*, *Aspergillus foetidus*, *Aspergillus fumigatus*, *Aspergillus giganteus*, *Aspergillus humicola*, *Aspergillus intermedius*, *Aspergillus japonicus*, *Aspergillus nidulans*, *Aspergillus niger*, *Aspergillus niveus*, *Aspergillus ochraceus*, *Aspergillus oryzae*, *Aspergillus ostianus*, *Aspergillus parasiticus*, *Aspergillus parasiticus* var. *globosus*, *Aspergillus penicillioides*, *Aspergillus phoenicis*, *Aspergillus rugulosus*, *Aspergillus sclerotiorum*, *Aspergillus sojae* var. *gymnosardae*, *Aspergillus sydowi*, *Aspergillus tamarii*, *Aspergillus terreus*, *Aspergillus terricola*, *Aspergillus toxicarius*, *Aspergillus unguis*, *Aspergillus ustus*, *Aspergillus versicolor*, *Aspergillus vitricolae*, *Aspergillus wentii*, •*Penicillium adametzi*, •*Penicillium albicans*, *Penicillium arabicum*, *Penicillium arenicola*, *Penicillium argillaceum*, *Penicillium arvense*, *Penicillium asperosporum*, •*Penicillium aurantiogriseum*, •*Penicillium avellaneum*, •*Penicillium baarnense*, •*Penicillium baciffisporum*, •*Penicillium brasilianum*, •*Penicillium brevicompactum*, •*Penicillium camemberti*, •*Penicillium canadense*, •*Penicillium canescens*, •*Penicillium caperatum*, •*Penicillium capsulatum*, •*Penicillium caseicolum*, •*Penicillium chrysogenum*, •*Penicillium citreonigrum*, •*Penicillium citrinum*, •*Penicillium claviforme*, •*Penicillium commune*, •*Penicillium corylophilum*, •*Penicillium corymbiferum*, •*Penicillium crustosum*, •*Penicillium cyclopium*, •*Penicillium daleae*, •*Penicillium decumbens*, •*Penicillium dierckxii*, •*Penicillium digitatum*, •*Penicillium digitatum* var. *latum*, •*Penicillium divaricatum*, •*Penicillium diversum*, •*Penicillium duclauxii*, •*Penicillium echinosporum*, •*Penicillium expansum*, •*Penicillium fellutanum*, •*Penicillium frequentans*, •*Penicillium funiculosum*, •*Penicillium glabrum*, •*Penicillium gladioli*, •*Penicillium griseofulvum*, •*Penicillium hirsutum*, •*Penicillium hispanicum*, •*Penicillium islandicum*, •*Penicillium italicum*, •*Penicillium italicum* var. *avellaneum*, •*Penicillium janczewskii*, •*Penicillium janthinellum*, •*Penicillium japonicum*, •*Penicillium lavendulum*, •*Penicillium lilacinum*, •*Penicillium lividum*, •*Penicillium martensii*, *Penicillium megasporum*, •*Penicillium miczynskii*, •*Penicillium nalgiovense*, •*Penicillium nigricans*, •*Penicillium notatum*, •*Penicillium ochrochloron*, •*Penicillium odoratum*, •*Penicillium oxalicum*, •*Penicillium paraherquei*, •*Penicillium patulum*, •*Penicillium pinophilum*, •*Penicillium piscarium*, •*Penicillium pseudostromaticum*, •*Penicillium puberulum*, •*Penicillium purpurogenum*, •*Penicillium raciborskii*, •*Penicillium roqueforti*, •*Penicillium rotundum*, •*Penicillium rubrum*, •*Penicillium sacculum*, •*Penicillium simplicissimum*, •*Penicillium* sp., *Penicillium spinulosum*, *Penicillium steckii*, *Penicillium stoloniferum*, *Penicillium striatisporum*, *Penicillium striatum*, *Penicillium tardum*, *Penicillium thomii*, *Penicillium turbatum*, *Penicillium variabile*, *Penicillium vermiculatum*, *Penicillium vermoesenii*, *Penicillium verrucosum*, *Penicillium verrucosum* var. *corymbiferum*, *Penicillium verrucosum* var. *cyclopium*, *Penicillium verruculosum*, *Penicillium vinaceum*, *Penicillium violaceum*, *Penicillium viridicatum*, *Penicillium vulpinum*, *Trichoderma hamatum*, *Trichoderma harzianum*, *Trichoderma koningii*, *Trichoderma longibrachiatum*, *Trichoderma polysporum*, *Trichoderma reesei*, *Trichoderma virens* or *Trichoderma viride*; Mortierellaceae such as the genera *Mortierella* e.g. the species *Mortierella isabellina*, *Mortierella polycephala*, *Mortierella ramanniana*, *Mortierella vinacea* or *Mortierella zonata*; Mucoraceae such as the genera *Actinomucor*, *Mucor*, *Phycomyces*, *Rhizopus*, *Zygorhynchus* e.g. the species *Mucor amphibiorum*, *Mucor circinelloides* f. *circinelloides*, *Mucor circinelloides* var. *griseocyanus*, *Mucor flavus*, *Mucor fuscus*, *Mucor griseocyanus*, *Mucor heterosporus*, *Mucor hiemalis*, *Mucor hiemalis* f.

*hiemalis, Mucor inaequisporus, Mucor indicus, Mucor javanicus, Mucor mucedo, Mucor mucilagineus, Mucor piriformis, Mucor plasmaticus, Mucor plumbeus, Mucor racemosus, Mucor racemosus* f. *racemosus, Mucor racemosus* f. *sphaerosporus, Mucor rouxianus, Mucor rouxii, Mucor sinensis, Mucor* sp., *Mucor spinosus, Mucor tuberculisporus, Mucor variisporus, Mucor variosporus, Mucor wosnessenskii, Phycomyces blakesleeanus, Rhizopus achlamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus* var. *chinensis, Rhizopus microsporus* var. *oligosporus, Rhizopus microsporus* var. *rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici* or *Rhizopus usamii*; Pythiaceae such as the genera *Phytium, Phytophthora* e.g. the species *Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae* var. *parasitica, Phytophthora palmivora, Phytophthora parasitica* or *Phytophthora syringae*; Sacharomycetaceae such as the genera *Hansenula, Pichia, Saccharomyces, Saccharomycodes, Yarrowia* e.g. the species *Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii, Pichia cellobiosa, Pichia ciferrii, Pichia farinosa, Pichia fermentans, Pichia finlandica, Pichia glucozyma, Pichia guiffiermondii, Pichia haplophila, Pichia henricii, Pichia holstii, Pichia jadinii, Pichia lindnerii, Pichia membranaefaciens, Pichia methanolica, Pichia minuta* var. *minuta, Pichia minuta* var. *nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces baffii, Saccharomyces bayanus, Saccharomyces bisporus, Saccharomyces capensis, Saccharomyces carlsbergensis, Saccharomyces cerevisiae, Saccharomyces cerevisiae* var. *ellipsoideus, Saccharomyces chevalieri, Saccharomyces delbrueckii, Saccharomyces diastaticus, Saccharomyces drosophilarum, Saccharomyces elegans, Saccharomyces effipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii* or *Yarrowia lipolytica*; Saprolegniaceae such as the genera *Saprolegnia* e.g. the species *Saprolegnia ferax*; Schizosacharomycetaceae such as the genera *Schizosaccharomyces* e.g. the species *Schizosaccharomyces japonicus* var. *japonicus, Schizosaccharomyces japonicus* var. *versatilis, Schizosaccharomyces malidevorans, Schizosaccharomyces octosporus, Schizosaccharomyces pombe* var. *malidevorans* or *Schizosaccharomyces pombe* var. *pombe*; Sodariaceae such as the genera *Neurospora, Sordaria* e.g. the species *Neurospora africana, Neurospora crassa, Neurospora intermedia, Neurospora sitophila, Neurospora tetrasperma, Sordaria fimicola* or *Sordaria macrospora*; Tuberculariaceae such as the genera *Epicoccum, Fusarium, Myrothecium, Sphacelia, Starkeyomyces, Tubercularia* e.g. the species *Fusarium acuminatum, Fusarium anthophilum, Fusarium aquaeductuum, Fusarium aquaeductuum* var. *medium, Fusarium avenaceum, Fusarium buharicum, Fusarium camptoceras, Fusarium cerealis, Fusarium chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusarium equiseti* var. *bullatum, Fusarium eumartii, Fusarium flocciferum, Fusarium fujikuroi, Fusarium graminearum, Fusarium graminum, Fusarium heterosporum, Fusarium incarnatum, Fusarium inflexum, Fusarium javanicum, Fusarium lateritium, Fusarium lateritium* var. *majus, Fusarium longipes, Fusarium melanochlorum, Fusarium merismoides, Fusarium merismoides* var. *chlamydosporale, Fusarium moniliforme, Fusarium moniliforme* var. *anthophilum, Fusarium moniliforme* var. *subglutinans, Fusarium nivale, Fusarium nivale* var. *majus, Fusarium oxysporum, Fusarium oxysporum* f. sp. *aechmeae, Fusarium oxysporum* f. sp. *cepae, Fusarium oxysporum* f. sp. *conglutinans, Fusarium oxysporum* f. sp. *cucumerinum, Fusarium oxysporum* f. sp. *cyclaminis, Fusarium oxysporum* f. sp. *dianthi, Fusarium oxysporum* f. sp. *lycopersici, Fusarium oxysporum* f. sp. *melonis, Fusarium oxysporum* f. sp. *passiflorae, Fusarium oxysporum* f. sp. *pisi, Fusarium oxysporum* f. sp. *tracheiphilum, Fusarium oxysporum* f. sp. *tuberosi, Fusarium oxysporum* f. sp. *tulipae, Fusarium oxysporum* f. sp. *vasinfectum, Fusarium pallidoroseum, Fusarium poae, Fusarium proliferatum, Fusarium proliferatum* var. *minus, Fusarium redolens, Fusarium redolens* f. sp. *dianthi, Fusarium reticulatum, Fusarium roseum, Fusarium sacchari* var. *elongatum, Fusarium sambucinum, Fusarium sambucinum* var. *coeruleum, Fusarium semitectum, Fusarium semitectum* var. *majus, Fusarium solani, Fusarium solani* f. sp. *pisi, Fusarium sporotrichioides, Fusarium sporotrichioides* var. *minus, Fusarium sublunatum, Fusarium succisae, Fusarium sulphureum, Fusarium tabacinum, Fusarium tricinctum, Fusarium udum, Fusarium ventricosum, Fusarium verticiffioides, Fusarium xylarioides* or *Fusarium zonatum*; Sporobolomycetaceae such as the genera *Bullera, Sporobolomyces, Itersonilia* e.g. the species *Sporobolomyces holsaticus, Sporobolomyces odorus, Sporobolomyces puniceus, Sporobolomyces salmonicolor, Sporobolomyces singularis* or *Sporobolomyces tsugae*; Adelotheciaceae such as the genera e.g. the species *Physcomitrella patens*; Dinophyceae such as the genera *Crypthecodinium, Phaeodactylum* e.g. the species *Crypthecodinium cohnii* or *Phaeodactylum tricornutum*; Ditrichaceae such as the genera *Ceratodon, Pleuridium, Astomiopsis, Ditrichum, Philibertiella, Ceratodon, Distichium, Skottsbergia* e.g. the species *Ceratodon antarcticus, Ceratodon purpureus, Ceratodon purpureus* ssp. *convolutes* or *Ceratodon purpureus* ssp. *stenocarpus*; Prasinophyceae such as the genera *Nephroselmis, Prasinococcus, Scherffelia, Tetraselmis, Mantoniella, Ostreococcus* e.g. the species *Nephroselmis olivacea, Prasi-* nococcus capsulatus, Scherffelia dubia, Tetraselmis chui, Tetraselmis suecica, Mantoniella squamata or Ostreococcus tauri; Actinomycetaceae such as the genera Actinomyces, Actinobaculum, Arcanobacterium, Mobiluncus e.g. the species Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii, Actinomyces marimammalium, Actinomyces meyeri, Actinomyces naeslundii, Actinomyces nasicola, Actinomyces neuii subsp. anitratus, Actinomyces neuii subsp. neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii subsp. curtisii, Mobiluncus curtisii subsp. holmesii or Mobiluncus mulieris; Bacillaceae such as the genera Amphibacillus, Anoxybacillus, Bacillus, Exiguobacterium, Gracilibacillus, Holobacillus, Saccharococcus, Salibacillus, Virgibacillus e.g. the species Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius, Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borstelensis, Bacillus brevis, Bacillus carbonifilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus subsp. fusiformis, Bacillus galactophilus, Bacillus globisporus, Bacillus globisporus subsp. marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquariensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis subsp. spizizenii, Bacillus subtilis subsp. subtilis, Bacillus thermantarcticus, Bacillus thermoaerophilus, Bacillus thermoamylovorans, Bacillus thermoantarcticus, Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetylicum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus truepefi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii or Virgibacillus salexigens, Brevibacteriaceae such as the genera Brevibacterium e.g. the species Brevibacterium acetylicum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum or Brevibacterium vitaeruminis; Corynebacteriaceae such as the genera Corynebacterium e.g. the species Corynebacterium accolens, Corynebacterium afermentans subsp. afermentans, Corynebacterium afermentans subsp. lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium ilicis, Corynebacterium imitans, Corynebacterium insidiosum, Corynebacterium iranicum, Corynebacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacterium michiganense subsp. tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis or Corynebacterium xerosis; Enterobacteriacae such as the genera Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingella, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia and Yokenella e.g. the species Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izardii, Buttiauxella noackiae, Buttiauxella warmboldiae, Cedecea davisae, Cedecea lapagei, Cedecea neteri, Citrobacter amalonaticus, Citrobacter diversus, Citrobacter freundii, Citrobacter genomospecies, Citrobacter gillenii, Citrobacter intermedium, Citrobacter koseri, Citrobacter murliniae, Citrobacter sp., Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora subsp. atroseptica, Erwinia carotovora subsp. betavasculorum, Erwinia carotovora subsp. odorifera, Erwinia carotovora subsp. wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxy/ata, Escherichia anindolica, Escherichia aurescens, Escherichia b/attae, Escherichia coli, Escherichia coli var. communior, Escherichia coli-mutabile, Escherichia fergusonii, Escherichia hermannii, Escherichia sp., Escherichia vulneris, Ewingella americana, Hafnia alvei, Klebsiella aerogenes, Klebsiella edwardsii subsp. atlantae, Klebsiella ornithinolytica, Klebsiella oxytoca, Klebsiella planticola, Klebsiella pneumoniae, Klebsiella pneumoniae subsp. pneumoniae, Klebsiella sp., Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera sp., Leclercia adecarboxylata, Leminorella grimontii, Leminorella richardii, Moellerella wisconsensis, Morganella morganii, Morganella morganii subsp. morganii, Morganella morganii subsp. Obesumbaterium proteus, Pantoea agglomerans, Pantoea ananatis, Pantoea citrea, Pantoea dispersa, Pantoea punctata, Pantoea stewartii subsp. stewartii, Pantoea terrea, Pectobacterium atrosepticum, Pectobacterium carotovorum subsp. atrosepticum, Pectobacterium carotovorum subsp. carotovorum, Pectobacterium chrysanthemi, Pectobacterium cypripedii, Photorhabdus asymbiotica, Photorhabdus luminescens, Photorhabdus luminescens subsp. akhurstii, Photorhabdus luminescens subsp. laumondii, Photorhabdus luminescens subsp. luminescens, Photorhabdus sp., Photorhabdus temperata, Plesiomonas shigelloides, Pragia fontium, Proteus hauseri, Proteus ichthyosmius, Proteus inconstans, Proteus mirabilis, Proteus morganii, Proteus myxofaciens, Proteus penneri, Proteus rettgeri, Proteus shigelloides, Proteus vulgaris, Providencia alcalifaciens, Providencia friedericiana, Providencia heimbachae, Providencia rettgeri, Providencia rustigianii, Providencia stuartii, Rahnella aquatilis, Salmonella abony, Salmonella arizonae, Salmonella bongori, Salmonella choleraesuis subsp. arizonae, Salmonella choleraesuis subsp. bongori, Salmonella choleraesuis subsp. choleraesuis, Salmonella choleraesuis subsp. diarizonae, Salmonella choleraesuis subsp. houtenae, Salmonella choleraesuis subsp. indica, Salmonella choleraesuis subsp. salamae, Salmonella daressalaam, Salmonella enterica subsp. houtenae, Salmonella enterica subsp. salamae, Salmonella enteritidis, Salmonella gallinarum, Salmonella heidelberg, Salmonella panama, Salmonella senftenberg, Salmonella typhimurium, Serratia entomophila, Serratia ficaria, Serratia fonticola, Serratia Serratia liquefaciens, Serratia marcescens, Serratia marcescens subsp. marcescens, Serratia marinorubra, Serratia odorifera, Serratia plymouthensis, Serratia plymuthica, Serratia proteamaculans, Serratia proteamaculans subsp. quinovora, Serratia quinivorans, Serratia rubidaea, Shigella boydii, Shigella flexneri, Shigella paradysenteriae, Shigella sonnet Tatumella ptyseos, Xenorhabdus beddingii, Xenorhabdus bovienii, Xenorhabdus luminescens, Xenorhabdus nematophila, Xenorhabdus nematophila subsp. beddingii, Xenorhabdus nematophila subsp. bovienii, Xenorhabdus nematophila subsp. poinarii or Xenorhabdus poinarii; Gordoniaceae such as the genera Gordonia, Skermania e.g. the species Gordonia aichiensis, Gordonia alkanivorans, Gordonia amarae, Gordonia amicalis, Gordonia bronchialis, Gordonia desulfuricans, Gordonia hirsuta, Gordonia hydrophobica, Gordonia namibiensis, Gordonia nitida, Gordonia paraffinivorans, Gordonia polyisoprenivorans, Gordonia rhizosphera, Gordonia rubripertincta, Gordonia sihwensis, Gordonia sinesedis, Gordonia sputi, Gordonia terrae or Gordonia westfalica; Micrococcaceae such as the genera Micrococcus, Arthrobacter, Kocuria, Nesterenkonia, Renibacterium, Rothia, Stomatococcus e.g. the species Micrococcus agilis, Micrococcus antarcticus, Micrococcus halobius, Micrococcus kristinae, Micrococcus luteus, Micrococcus lylae, Micrococcus nishinomiyaensis, Micrococcus roseus, Micrococcus sedentarius, Micrococcus varians, Arthrobacter agilis, Arthrobacter albus, Arthrobacter atrocyaneus, Arthrobacter aurescens, Arthrobacter chlorophenolicus, Arthrobacter citreus, Arthrobacter creatinolyticus, Arthrobacter crystallopoietes, Arthrobacter cumminsii, Arthrobacter duodecadis, Arthrobacter flavescens, Arthrobacter flavus, Arthrobacter gandavensis, Arthrobacter globiformis, Arthrobacter histidinolovorans, Arthrobacter Arthrobacter koreensis, Arthrobacter luteolus, Arthrobacter methylotrophus, Arthrobacter mysorens, Arthrobacter nasiphocae, Arthrobacter nicotianae, Arthrobacter nicotinovorans, Arthrobacter oxydans, Arthrobacter

*pascens, Arthrobacter picolinophilus, Arthrobacter polychromogenes, Arthrobacter protophormiae, Arthrobacter psychrolactophilus, Arthrobacter radiotolerans, Arthrobacter ramosus, Arthrobacter rhombi, Arthrobacter roseus, Arthrobacter siderocapsulatus, Arthrobacter simplex, Arthrobacter sulfonivorans, Arthrobacter sulfureus, Arthrobacter terregens, Arthrobacter tumescens, Arthrobacter uratoxydans, Arthrobacter ureafaciens, Arthrobacter variabilis, Arthrobacter viscosus, Arthrobacter woluwensis, Kocuria erythromyxa, Kocuria kristinae, Kocuria palustris, Kocuria polaris, Kocuria rhizophila, Kocuria rosea, Kocuria varians, Nesterenkonia halobia, Nesterenkonia lacusekhoensis, Renibacterium salmoninarum, Rothia amarae, Rothia dentocariosa, Rothia mucilaginosa, Rothia nasimurium* or *Stomatococcus mucilaginosus*; Mycobacteriaceae such as the genera *Mycobacterium* e.g. the species *Mycobacterium africanum, Mycobacterium agri, Mycobacterium aichiense, Mycobacterium alvei, Mycobacterium asiaticum, Mycobacterium aurum, Mycobacterium austroafricanum, Mycobacterium bohemicum, Mycobacterium botniense, Mycobacterium brumae, Mycobacterium chelonae* subsp. *abscessus, Mycobacterium chitae, Mycobacterium chlorophenolicum, Mycobacterium chubuense, Mycobacterium confluentis, Mycobacterium cookii, Mycobacterium diernhoferi, Mycobacterium doricum, Mycobacterium duvalii, Mycobacterium fallax, Mycobacterium farcinogenes, Mycobacterium flavescens, Mycobacterium frederiksbergense, Mycobacterium gadium, Mycobacterium gilvum, Mycobacterium gordonae, Mycobacterium hassiacum, Mycobacterium hiberniae, Mycobacterium hodleri, Mycobacterium holsaticum, Mycobacterium komossense, Mycobacterium lacus, Mycobacterium madagascariense, Mycobacterium mageritense, Mycobacterium montefiorense, Mycobacterium moriokaense, Mycobacterium murale, Mycobacterium neoaurum, Mycobacterium nonchromogenicum, Mycobacterium obuense, Mycobacterium palustre, Mycobacterium parafortuitum, Mycobacterium peregrinum, Mycobacterium phlei, Mycobacterium pinnipedii, Mycobacterium poriferae, Mycobacterium pulveris, Mycobacterium rhodesiae, Mycobacterium shottsii, Mycobacterium sphagni, Mycobacterium terrae, Mycobacterium the rmoresistibile, Mycobacterium tokaiense, Mycobacterium triviale, Mycobacterium tusciae* or *Mycobacterium vanbaalenii*; Nocardiaceae such as the genera *Nocardia, Rhodococcus* e.g. the species *Nocardia abscessus, Nocardia africana, Nocardia amarae, Nocardia asteroides, Nocardia autotrophica, Nocardia beijingensis, Nocardia brasiliensis, Nocardia brevicatena, Nocardia caishijiensis, Nocardia calcarea, Nocardia carnea, Nocardia cellulans, Nocardia cerradoensis, Nocardia coeliaca, Nocardia corynebacterioides, Nocardia crassostreae, Nocardia cummidelens, Nocardia cyriacigeorgica, Nocardia farcinica, Nocardia flavorosea, Nocardia fluminea, Nocardia globerula, Nocardia hydrocarbonoxydans, Nocardia ignorata, Nocardia mediterranei, Nocardia nova, Nocardia orientalis, Nocardia otitidis-caviarum, Nocardia otitidiscaviarum, Nocardia paucivorans, Nocardia petroleophila, Nocardia pinensis, Nocardia pseudobrasiliensis, Nocardia pseudovaccinii, Nocardia puris, Nocardia restricta, Nocardia rugosa, Nocardia salmonicida, Nocardia saturnea, Nocardia seriolae, Nocardia soli, Nocardia sulphurea, Nocardia transvalensis, Nocardia uniformis, Nocardia vaccinii, Nocardia veterana* or *Nocardia vinacea*; Pseudomonaceae such as the genera *Azomonas, Azotobacter, Cellvibrio, Chryseomonas, Flaviomonas, Lampropedia, Mesophilobacter, Morococcus, Oligella, Pseudomonas, Rhizobacter, Rugamonas, Serpens, Thermoleophilum, Xylophilus* e.g. the species *Azomonas agilis, Azomonas insignis, Azomonas macrocytogenes, Azotobacter agilis, Azotobacter agilis* subsp. *armeniae, Azotobacter armeniacus, Azotobacter beijerinckii, Azotobacter chroococcum, Azotobacter indicum, Azotobacter macrocytogenes, Azotobacter miscellum, Azotobacter nigricans* subsp. *nigricans, Azotobacter paspali, Azotobacter salinestris, Azotobacter* sp., *Azotobacter vinelandii, Flavimonas oryzihabitans, Mesophilobacter marinus, Oligella urethralis, Pseudomonas acidovorans, Pseudomonas aeruginosa, Pseudomonas agarici, Pseudomonas alcaligenes, Pseudomonas aminovorans, Pseudomonas amygdali, Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocoffigans, Pseudomonas balearica, Pseudomonas barkeri, Pseudomonas bathycetes, Pseudomonas beijerinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chloritidismutans, Pseudomonas chlororaphis, Pseudomonas cichorii, Pseudomonas citronellolis, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes* subsp. *konjaci, Pseudomonas pseudoalcaligenes* subsp. *pseudoalcaligenes, Pseudomonas pseudoflava, Pseudomonas putida, Pseudomonas putida* var. *naraensis, Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbi-* cans, *Pseudomonas ruhlandii*, *Pseudomonas saccharophila*, *Pseudomonas savastanoi*, *Pseudomonas savastanoi* pvar. *glycinea*, *Pseudomonas savastanoi* pvar. *phaseolicola*, *Pseudomonas solanacearum*, *Pseudomonas* sp., *Pseudomonas spinosa*, *Pseudomonas stanieri*, *Pseudomonas stutzeri*, *Pseudomonas syringae*, *Pseudomonas syringae* pvar. *aptata*, *Pseudomonas syringae* pvar. *atrofaciens*, *Pseudomonas syringae* pvar. *coronafaciens*, *Pseudomonas syringae* pvar. *delphinii*, *Pseudomonas syringae* pvar. *glycinea*, *Pseudomonas syringae* pvar. *helianthi*, *Pseudomonas syringae* pvar. *lachrymans*, *Pseudomonas syringae* pvar. *lapsa*, *Pseudomonas syringae* pvar. *morsprunorum*, *Pseudomonas syringae* pvar. *phaseolicola*, *Pseudomonas syringae* pvar. *primulae*, *Pseudomonas syringae* pvar. *syringae*, *Pseudomonas syringae* pvar. *tabaci*, *Pseudomonas syringae* pvar. *tomato*, *Pseudomonas syringae* subsp. *glycinea*, *Pseudomonas syringae* subsp. *savastanoi*, *Pseudomonas syringae* subsp. *syringae*, *Pseudomonas syzygii*, *Pseudomonas tabaci*, *Pseudomonas taeniospiralis*, *Pseudomonas testosteroni*, *Pseudomonas thermocarboxydovorans*, *Pseudomonas thermotolerans*, *Pseudomonas thivervalensis*, *Pseudomonas tomato*, *Pseudomonas trivialis*, *Pseudomonas veronii*, *Pseudomonas vesicularis*, *Pseudomonas viridiflava*, *Pseudomonas viscogena*, *Pseudomonas woodsii*, *Rhizobacter dauci*, *Rhizobacter daucus* or *Xylophilus ampelinus*; Rhizobiaceae such as the genera *Agrobacterium*, *Carbophilus*, *Chelatobacter*, *Ensifer*, *Rhizobium*, *Sinorhizobium* e.g. the species *Agrobacterium atlanticum*, *Agrobacterium ferrugineum*, *Agrobacterium gelatinovorum*, *Agrobacterium larrymoorei*, *Agrobacterium meteori*, *Agrobacterium radiobacter*, *Agrobacterium rhizogenes*, *Agrobacterium rubi*, *Agrobacterium stellulatum*, *Agrobacterium tumefaciens*, *Agrobacterium vitis*, *Carbophilus carboxidus*, *Chelatobacter heintzii*, *Ensifer adhaerens*, *Ensifer arboris*, *Ensifer fredii*, *Ensifer kostiensis*, *Ensifer kummerowiae*, *Ensifer medicae*, *Ensifer meliloti*, *Ensifer saheli*, *Ensifer terangae*, *Ensifer xinjiangensis*, *Rhizobium ciceri* *Rhizobium etli*, *Rhizobium fredii*, *Rhizobium galegae*, *Rhizobium gafficum*, *Rhizobium giardinii*, *Rhizobium hainanense*, *Rhizobium huakuii*, *Rhizobium huautlense*, *Rhizobium indigoferae*, *Rhizobium japonicum*, *Rhizobium leguminosarum*, *Rhizobium loessense*, *Rhizobium loti*, *Rhizobium lupini*, *Rhizobium mediterraneum*, *Rhizobium meliloti*, *Rhizobium mongolense*, *Rhizobium phaseoli*, *Rhizobium radiobacter*, *Rhizobium rhizogenes*, *Rhizobium rubi*, *Rhizobium sullae*, *Rhizobium tianshanense*, *Rhizobium trifolii*, *Rhizobium tropici*, *Rhizobium undicola*, *Rhizobium vitis*, *Sinorhizobium adhaerens*, *Sinorhizobium arboris*, *Sinorhizobium fredii*, *Sinorhizobium kostiense*, *Sinorhizobium kummerowiae*, *Sinorhizobium medicae*, *Sinorhizobium meliloti*, *Sinorhizobium morelense*, *Sinorhizobium saheli* or *Sinorhizobium xinjiangense*; Streptomycetaceae such as the genera *Kitasatosprora*, *Streptomyces*, *Streptoverticillium* e.g. the species *Streptomyces abikoensis*, *Streptomyces aburaviensis*, *Streptomyces achromogenes* subsp. *achromogenes*, *Streptomyces achromogenes* subsp. *rubradiris*, *Streptomyces acidiscabies*, *Streptomyces acrimycini*, *Streptomyces aculeolatus*, *Streptomyces afghaniensis*, *Streptomyces alanosinicus*, *Streptomyces albaduncus*, *Streptomyces albiaxialis*, *Streptomyces albidochromogenes*, *Streptomyces albidoflavus*, *Streptomyces albireticuli*, *Streptomyces albofaciens*, *Streptomyces alboflavus*, *Streptomyces albogriseolus*, *Streptomyces albolongus*, *Streptomyces alboniger*, *Streptomyces albospinus*, *Streptomyces albosporeus* subsp. *albosporeus*, *Streptomyces albosporeus* subsp. *labilomyceticus*, *Streptomyces alboverticillatus*, *Streptomyces albovinaceus*, *Streptomyces alboviridis*, *Streptomyces albulus*, *Streptomyces albus* subsp. *albus*, *Streptomyces albus* subsp. *pathocidicus*, *Streptomyces almquistii*, *Streptomyces althioticus*, *Streptomyces amakusaensis*, *Streptomyces ambofaciens*, *Streptomyces aminophilus*, *Streptomyces anandii*, *Streptomyces anthocyanicus*, *Streptomyces antibioticus*, *Streptomyces antimycoticus*, *Streptomyces anulatus*, *Streptomyces arabicus*, *Streptomyces ardus*, *Streptomyces arenae*, *Streptomyces argenteolus*, *Streptomyces armeniacus*, *Streptomyces asiaticus*, *Streptomyces asterosporus*, *Streptomyces atratus*, *Streptomyces atroaurantiacus*, *Streptomyces atroolivaceus*, *Streptomyces atrovirens*, *Streptomyces aurantiacus*, *Streptomyces aurantiogriseus*, *Streptomyces aureocirculatus*, *Streptomyces aureofaciens*, *Streptomyces aureorectus*, *Streptomyces aureoversilis*, *Streptomyces aureoverticillatus*, *Streptomyces aureus*, *Streptomyces avellaneus*, *Streptomyces avermectinius*, *Streptomyces avermitilis*, *Streptomyces avidinii*, *Streptomyces azaticus*, *Streptomyces azureus*, *Streptomyces baarnensis*, *Streptomyces bacillaris*, *Streptomyces badius*, *Streptomyces baldaccii*, *Streptomyces bambergiensis*, *Streptomyces beijiangensis*, *Streptomyces bellus*, *Streptomyces bikiniensis*, *Streptomyces biverticillatus*, *Streptomyces blastmyceticus*, *Streptomyces bluensis*, *Streptomyces bobili*, *Streptomyces bottropensis*, *Streptomyces brasiliensis*, *Streptomyces bungoensis*, *Streptomyces cacaoi* subsp. *asoensis*, *Streptomyces cacaoi* subsp. *cacaoi*, *Streptomyces caelestis*, *Streptomyces caeruleus*, *Streptomyces californicus*, *Streptomyces calvus*, *Streptomyces canaries*, *Streptomyces candidus*, *Streptomyces canescens*, *Streptomyces cangkringensis*, *Streptomyces caniferus*, *Streptomyces canus*, *Streptomyces capillispiralis*, *Streptomyces capoamus*, *Streptomyces carpaticus*, *Streptomyces carpinensis*, *Streptomyces catenulae*, *Streptomyces caviscabies*, *Streptomyces cavourensis* subsp. *cavourensis*, *Streptomyces cavourensis* subsp. *washingtonensis*, *Streptomyces cellostaticus*, *Streptomyces celluloflavus*, *Streptomyces cellulolyticus*, *Streptomyces cellulosae*, *Streptomyces champavatii*, *Streptomyces chartreuses*, *Streptomyces chattanoogensis*, *Streptomyces chibaensis*, *Streptomyces chrestomyceticus*, *Streptomyces chromofuscus*, *Streptomyces chryseus*, *Streptomyces chrysomallus* subsp. *chrysomallus*, *Streptomyces chrysomallus* subsp. *fumigatus*, *Streptomyces cinereorectus*, *Streptomyces cinereoruber* subsp. *cinereoruber*, *Streptomyces cinereoruber* subsp. *fructofermentans*, *Streptomyces cinereospinus*, *Streptomyces cinereus*, *Streptomyces cinerochromogenes*, *Streptomyces cinnabarinus*, *Streptomyces cinnamonensis*, *Streptomyces cinnamoneus*, *Streptomyces cinnamoneus* subsp. *albosporus*, *Streptomyces cinnamoneus* subsp. *cinnamoneus*, *Streptomyces cinnamoneus* subsp. *lanosus*, *Streptomyces cinnamoneus* subsp. *sparsus*, *Streptomyces cirratus*, *Streptomyces ciscaucasicus*, *Streptomyces citreofluorescens*, *Streptomyces clavifer*, *Streptomyces clavuligerus*, *Streptomyces cochleatus*, *Streptomyces coelescens*, *Streptomyces coelicoflavus*, *Streptomyces coelicolor*, *Streptomyces coeruleoflavus*, *Streptomyces coeruleofuscus*, *Streptomyces coeruleoprunus*, *Streptomyces coeruleorubidus*, *Streptomyces coerulescens*, *Streptomyces collinus*, *Streptomyces colombiensis*, *Streptomyces corchorusii*, *Streptomyces costaricanus*, *Streptomyces cremeus*, *Streptomyces crystallinus*, *Streptomyces curacoi*, *Streptomyces cuspidosporus*, *Streptomyces cyaneofuscatus*, *Streptomyces cyaneus*, *Streptomyces cyanoalbus*, *Streptomyces cystargineus*, *Streptomyces daghestanicus*, *Streptomyces diastaticus* subsp. *ardesiacus*, *Streptomyces diastaticus* subsp. *diastaticus*, *Streptomyces diastatochromogenes*, *Streptomyces distallicus*, *Streptomyces djakartensis*, *Streptomyces durhamensis*, *Streptomyces echinatus*, *Streptomyces echinoruber*, *Streptomyces ederensis*, *Streptomyces ehimensis*, *Streptomyces endus*, *Streptomyces enissocaesilis*, *Streptomyces erumpens*, *Streptomyces erythraeus*, *Streptomyces* erythrogriseus, Streptomyces eurocidicus, Streptomyces europaeiscabiei, Streptomyces eurythermus, Streptomyces exfoliates, Streptomyces felleus, Streptomyces fervens, Streptomyces fervens subsp. fervens, Streptomyces fervens subsp. melrosporus, Streptomyces filamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flaviscleroticus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatiscleroticus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces Streptomyces glaucescens, Streptomyces glaucosporus, Streptomyces glaucus, Streptomyces globisporus subsp. caucasicus, Streptomyces globisporus subsp. flavofuscus, Streptomyces globisporus subsp. globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocarneus, Streptomyces griseochromogenes, Streptomyces griseoflavus, Streptomyces griseofuscus, Streptomyces griseoincarnatus, Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces griseoverticillatus, Streptomyces griseoviridis, Streptomyces griseus subsp. alpha, Streptomyces griseus subsp. cretosus, Streptomyces griseus subsp. griseus, Streptomyces griseus subsp. solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus subsp. angustmyceticus, Streptomyces hygroscopicus subsp. decoyicus, Streptomyces hygroscopicus subsp. glebosus, Streptomyces hygroscopicus subsp. hygroscopicus, Streptomyces hygroscopicus subsp. ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae subsp. grasserius, Streptomyces lavendulae subsp. lavendulae, Streptomyces lavenduligriseus, Streptomyces lavendulocolor, Streptomyces levis, Streptomyces libani subsp. libani, Streptomyces libani subsp. rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces matensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporeus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli subsp. cellulophilus, Streptomyces olivoreticuli subsp. olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramulosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus subsp. paromomycinus, Streptomyces rimosus subsp. rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, Streptomyces rubiginosohelvolus, Streptomyces rubiginosus, Streptomyces rubrogriseus, Streptomyces rutgersensis subsp. castelarensis, Streptomyces rutgersensis subsp. rutgersensis, Streptomyces salmonis, Streptomyces sampsonii, *Streptomyces sanglieri, Streptomyces sannanensis, Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces the rmodiastaticus, Streptomyces thermogriseus, Streptomyces thermolineatus, Streptomyces thermonitrificans, Streptomyces thermospinosisporus, Streptomyces thermoviolaceus* subsp. *apingens, Streptomyces thermoviolaceus* subsp. *thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vinaceus, Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticiffium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium blastmyceticum, Streptoverticillium cinnamoneum* subsp. *albosporum, Streptomyces cinnamoneus* subsp. *albosporus, Streptoverticillium cinnamoneum* subsp. *cinnamoneum, Streptoverticillium cinnamoneum* subsp. *lanosum, Streptoverticillium cinnamoneum* subsp. *sparsum, Streptoverticillium distallicum, Streptoverticillium ehimense, Streptoverticillium eurocidicum, Streptoverticillium fervens* subsp. *fervens, Streptoverticillium fervens* subsp. *melrosporus, Streptoverticillium flavopersicum, Streptoverticillium griseocarneum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli* subsp. *cellulophilum, Streptoverticillium olivoreticuli* subsp. *olivoreticuli, Streptoverticillium olivoreticulum, Streptoverticillium olivoreticulum* subsp. *cellulophilum, Streptoverticillium olivoverticillatum, Streptoverticillium orinoci, Streptoverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptoverticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum.*

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida Candida bombicola, Candida cylindracea, Candida parapsilosis, Candida rugosa, Candida tropicalis, Pichia methanolica* and *Pichia pastoris.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus columa* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species

*Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya [papaya]*; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta [manihot,* arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocoas* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans macrocarpa, Juglans nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elaeis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cemuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticiffiflorum, Sorghum vulgare, Holcus halepensis, Sorghum miliaceum millet, Panicum militaceum [Sorghum, millet], Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia [macadamia]*; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum*

*annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can in principle also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold], Brassicaceae such as the genera *Brassica, Arabadopsis* e.g. the species *Brassica napus, Brassica rapa* ssp. [canola, oilseed rape, turnip rape] or *Arabidopsis thaliana*. Fabaceae such as the genera *Glycine* e.g. the species *Glycine max, Soja hispida* or *Soja max* [soybean] (wobei ich nicht sicher bin, ob es Soja max überhaupt gibt, die heißt eigentlich *Glycine max*). Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor [Sorghum, millet], Oryza sativa, Oryza latifolia* [rice], *Zea mays* [corn, maize]*Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum., Lycopersicon pyriforme, Solanum integrifolium* or *Solanum lycopersicum* [tomato].

All abovementioned organisms can in principle also function as host organisms.

With regard to the nucleic acid sequence as depicted a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) a nucleic acid sequence as indicated in Table I, columns 5 or 7, lines 243 to 250 and 603, or a derivative thereof, or
b) a genetic regulatory element, for example a promoter, which is functionally linked to the nucleic acid sequence as indicated in Table I, columns 5 or 7, lines 243 to 250 and 603, or a derivative thereof, or
c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The respective fine chemical, which is synthesized in the organism, in particular the microorganism, the cell, the tissue or the plant, of the invention can be isolated if desired. Depending on the use of the respective fine chemical, different purities resulting from the purification may be advantageous as will be described herein below.

In an advantageous embodiment of the invention, the organism takes the form of a plant whose content of the respective fine chemical is modified advantageously owing to the nucleic acid molecule of the present invention expressed. This is important for plant breeders since, for example, the nutritional value of plants for animals such as poultry is dependent on the abovementioned fine chemicals or the plants are more resistant to biotic and abiotic stress and the yield is increased.

In an advantageous embodiment of the invention, the organism takes the form of a plant whose amino acid content is modified advantageously owing to the nucleic acid molecule of the present invention expressed. This is important for plant breeders since, for example, the nutritional value of plants for monogastric animals is limited by a few essential amino acids such as lysine, threonine or methionine.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are amino acids or amino acid compositions which can still comprise further plant components in different amounts, advantageously in the range of from 0 to 99% by weight, preferably from below 90% by weight, especially preferably below 80% by weight. The plants can also advantageously be used directly without further processing, e.g. as feed or for extraction.

The chemically pure respective fine chemical or chemically pure compositions comprising the respective fine chemical may also be produced by the process described above. To this end, the respective fine chemical or the compositions are isolated in the known manner from an organism according to the invention, such as the microorganisms, non-human animal or the plants, and/or their culture medium in which or on which the organisms had been grown. These chemically pure respective fine chemical or said compositions are advantageous for applications in the field of the food industry, the cosmetics industry or the pharmaceutical industry.

Thus, the content of plant components and preferably also further impurities is as low as possible, and the abovementioned respective fine chemical is obtained in as pure form as possible. In these applications, the content of plant components advantageously amounts to less than 10%, preferably 1%, more preferably 0.1%, very especially preferably 0.01% or less.

Accordingly, the respective fine chemical produced by the present invention is at least 0.1% by weight pure, preferably more than 1% by weight pure, more preferred 10% by weight pure, even more preferred are more than 50, 60, 70 or 80% by weight purity, even more preferred are more than 90 weight-% purity, most preferred are 95% by weight, 99% by weight or more.

In this context, the amount of the respective fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found a tissue, more preferred in an organism or in a harvestable part thereof.

In principle, the respective fine chemicals produced can be increased in two ways by the process according to the invention. The pool of free respective fine chemicals, in particular of the free respective fine chemical, and/or the content of protein-bound respective fine chemicals, in particular of the protein-bound respective fine chemical may advantageously be increased.

It may be advantageous to increase the pool of ferulic acid or sinapic acid in the transgenic organisms by the process according to the invention in order to isolate high amounts of the pure respective fine chemical and/or to obtain increased resistance against biotic and abiotic stresses and to obtain higher yield.

In another preferred embodiment of the invention a combination of the increased expression of the nucleic acid sequence or the protein of the invention together with the transformation of a protein or polypeptide or a compound, which functions as a sink for the desired fine chemical, for example in the organism, is useful to increase the production of the respective fine chemical.

In may also be advantageous to increase the content of the protein-bound respective fine chemical.

In a preferred embodiment, the respective fine chemical is produced in accordance with the invention and, if desired, is isolated.

In the case of the fermentation of microorganisms, the abovementioned desired fine chemical may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. Afterwards advantageously further compounds for formulation can be added such as corn starch or silicates. This concentrated fermentation broth advantageously together with compounds for the formulation can subsequently be processed by lyophilization, spray drying, and spray granulation or by other methods. Preferably the respective fine chemical comprising compositions are isolated from the organisms, such as the microorganisms or plants or the culture medium in or on which the organisms have been grown, or from the organism and the culture medium, in the known manner, for example via extraction, distillation, crystallization, chromatography or a combination of these methods. These purification methods can be used alone or in combination with the aforementioned methods such as the separation and/or concentration methods.

Transgenic plants which comprise the fine chemicals such as ferulic acid or sinapic acid synthesized in the process according to the invention can advantageously be marketed directly without there being any need for the fine chemicals synthesized to be isolated. Plants for the process according to the invention are listed as meaning intact plants and all plant parts, plant organs or plant parts such as leaf, stem, seeds, root, tubers, anthers, fibers, root hairs, stalks, embryos, calli, cotelydons, petioles, harvested material, plant tissue, reproductive tissue and cell cultures which are derived from the actual transgenic plant and/or can be used for bringing about the transgenic plant. In this context, the seed comprises all parts of the seed such as the seed coats, epidermal cells, seed cells, endosperm or embryonic tissue.

However, the respective fine chemical produced in the process according to the invention can also be isolated from the organisms, advantageously plants, as extracts, e.g. ether, alcohol, or other organic solvents or water containing extract and/or free fine chemicals. The respective fine chemical produced by this process can be obtained by harvesting the organisms, either from the crop in which they grow, or from the field. This can be done via pressing or extraction of the plant parts. To increase the efficiency of extraction it is beneficial to clean, to temper and if necessary to hull and to flake the plant material. To allow for greater ease of disruption of the plant parts, specifically the seeds, they can previously be comminuted, steamed or roasted. Seeds, which have been pretreated in this manner can subsequently be pressed or extracted with solvents such as warm hexane. The solvent is subsequently removed. In the case of microorganisms, the latter are, after harvesting, for example extracted directly without further processing steps or else, after disruption, extracted via various methods with which the skilled worker is familiar. Thereafter, the resulting products can be processed further, i.e. degummed and/or refined. In this process, substances such as the plant mucilages and suspended matter can be first removed. What is known as desliming can be affected enzymatically or, for example, chemico-physically by addition of acid such as phosphoric acid.

Because ferulic acid or sinapic acid in microorganisms are localized intracellular, their recovery essentially comes down to the isolation of the biomass. Well-established approaches for the harvesting of cells include filtration, centrifugation and coagulation/flocculation as described herein. Of the residual hydrocarbon, adsorbed on the cells, has to be removed. Solvent extraction or treatment with surfactants have been suggested for this purpose.

The identity and purity of the compound(s) isolated can be determined by prior-art techniques. They encompass high-performance liquid chromatography (HPLC), gas chromatography (GC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Ferulic acid or sinapic acid can for example be detected advantageously via HPLC, LC or GC separation methods. The unambiguous detection for the presence of ferulic acid or sinapic acid containing products can be obtained by analyzing recombinant organisms using analytical standard methods: LC, LC-MS, MS or TLC). The material to be analyzed can be disrupted by sonication, grinding in a glass mill, liquid nitrogen and grinding, cooking, or via other applicable methods.

In a preferred embodiment, the present invention relates to a process for the production of the respective fine chemical comprising or generating in an organism or a part thereof the expression of at least one nucleic acid molecule comprising a nucleic acid molecule selected from the group consisting of:

a) nucleic acid molecule encoding, preferably at least the mature form, of the polypeptide having a sequence as indicated in Table II, columns 5 or 7, lines 243 to 250 and 603, or a fragment thereof, which confers an increase in the amount of the respective fine chemical in an organism or a part thereof;
b) nucleic acid molecule comprising, preferably at least the mature form, of a nucleic acid molecule having a sequence as indicated in Table I, columns 5 or 7, lines 243 to 250 and 603,
c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;
d) nucleic acid molecule encoding a polypeptide which has at least 50% identity with the amino acid sequence of the polypeptide encoded by the nucleic acid molecule of (a) to (c) and conferring an increase in the amount of the respective fine chemical in an organism or a part thereof;
e) nucleic acid molecule which hybridizes with a nucleic acid molecule of (a) to (c) under stringent hybridization conditions and conferring an increase in the amount of the respective fine chemical in an organism or a part thereof;
f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the respective fine chemical in an organism or a part thereof;
g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;
h) nucleic acid molecule comprising a nucleic acid molecule which is obtained by amplifying nucleic acid molecules from a cDNA library or a genomic library using the primers pairs having a sequence as indicated in Table III, columns 7, lines 243 to 250 and 603, and conferring an increase in the amount of the respective fine chemical in an organism or a part thereof;
i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and conferring an increase in the amount of the respective fine chemical in an organism or a part thereof;
j) nucleic acid molecule which encodes a polypeptide comprising the consensus sequence having a sequences as indicated in Table IV, column 7, lines 243 to 250 and 603 and conferring an increase in the amount of the respective fine chemical in an organism or a part thereof;
k) nucleic acid molecule comprising one or more of the nucleic acid molecule encoding the amino acid sequence of a polypeptide encoding a domain of the polypeptide indicated in Table II, columns 5 or 7, lines 243 to 250 and 603, and conferring an increase in the amount of the respective fine chemical in an organism or a part thereof; and
l) nucleic acid molecule which is obtainable by screening a suitable library under stringent conditions with a probe comprising one of the sequences of the nucleic acid molecule of (a) to (k), preferably to (a) to (c), or with a fragment of at least 15 nt, preferably 20 nt, 30 nt, 50 nt, 100 nt, 200 nt or 500 nt of the nucleic acid molecule characterized in (a) to (k), preferably to (a) to (c), and conferring an increase in the amount of the respective fine chemical in an organism or a part thereof;

or which comprises a sequence which is complementary thereto.

In one embodiment, the nucleic acid molecule used in the process of the invention distinguishes over the sequence indicated in Table IA, columns 5 or 7, lines 243 to 250 and 603, by one or more nucleotides. In one embodiment, the nucleic acid molecule used in the process of the invention does not consist of the sequence shown in indicated in Table I A, columns 5 or 7, lines 243 to 250 and 603. In one embodiment, the nucleic acid molecule used in the process of the invention is less than 100%, 99.999%, 99.99%, 99.9% or 99% identical to a sequence indicated in Table I A, columns 5 or 7, lines 243 to 250 and 603. In another embodiment, the nucleic acid molecule does not encode a polypeptide of a sequence indicated in Table II A, columns 5 or 7, lines 243 to 250 and 603.

In one embodiment, the nucleic acid molecule used in the process of the invention distinguishes over the sequence indicated in Table I B, columns 5 or 7, lines 243 to 250 and 603, by one or more nucleotides. In one embodiment, the nucleic acid molecule used in the process of the invention does not consist of the sequence shown in indicated in Table I B, columns 5 or 7, lines 243 to 250 and 603. In one embodiment, the nucleic acid molecule used in the process of the invention is less than 100%, 99.999%, 99.99%, 99.9% or 99% identical to a sequence indicated in Table I B, columns 5 or 7, lines 243 to 250 and 603. In another embodiment, the nucleic acid molecule does not encode a polypeptide of a sequence indicated in Table II B, columns 5 or 7, lines 243 to 250 and 603.

In one embodiment, the nucleic acid molecule used in the process of the present invention distinguishes over the sequence indicated in Table I, columns 5 or 7, lines 243 to 250 and 603 by one or more nucleotides. In one embodiment, the nucleic acid molecule used in the process of the invention does not consist of the sequence indicated in Table I, columns 5 or 7, lines 243 to 250 and 603 In one embodiment, the nucleic acid molecule of the present invention is less than 100%, 99.999%, 99.99%, 99.9% or 99% identical to the sequence indicated in Table I, columns 5 or 7, lines 243 to 250 and 603. In another embodiment, the nucleic acid molecule does not encode a polypeptide of a sequence indicated in Table II, columns 5 or 7, lines 243 to 250 and 603.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, The terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as indicated in Table I, columns 5 or 7, lines 243 to 250 and 603, nucleic acid molecules which are derived from an amino acid sequences as indicated in Table II, columns 5 or 7, lines 243 to 250 and 603 or from polypeptides comprising the consensus sequence as indicated in Table IV, column 7, lines 243 to 250 and 603, or their derivatives or homologues encoding polypeptides with the enzymatic or biological activity of an activity of a polypeptide as indicated in Table II, column 3, 5 or 7, lines 243 to 250 and 603, e.g. conferring the increase of the respective fine chemical, meaning ferulic acid or sinapic acid, resp., after increasing its expression or activity, are advantageously increased in the process according to the invention.

In one embodiment, said sequences are cloned into nucleic acid constructs, either individually or in combination. These nucleic acid constructs enable an optimal synthesis of the respective fine chemicals, in particular ferulic acid or sinapic acid, produced in the process according to the invention.

Nucleic acid molecules, which are advantageous for the process according to the invention and which encode polypeptides with an activity of a polypeptide used in the method of the invention or used in the process of the invention, e.g. of a protein as shown in Table II, columns 5 or 7, lines 243 to 250 and 603 or being encoded by a nucleic acid molecule indicated in Table I, columns 5 or 7, lines 243 to 250 and 603 or of its homologs, e.g. as indicated in Table II, columns 5 or 7, lines 243 to 250 and 603 can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Chemy J. M. et al., Nucleic Acids Res. 1998, Vol. 26, 73-80) or the MIPS database (Mewes H. W. et al., Nucleic Acids Res. 1999, Vol. 27, 44-48), in the case of *E. coli* the GenProtEC database (http://web.bham.ac.uk/bcm4ght6/res.html), and in the case of *Arabidopsis* the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides with an activity of a polypeptide as indicated in Table II, column 3, lines 243 to 250 and 603 or having the sequence of a polypeptide as indicated in Table II, columns 5 and 7, lines 243 to 250 and 603 and conferring an increase in the ferulic acid or sinapic acid level.

The nucleic acid sequence(s) used in the process for the production of the respective fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of the respective fine chemical produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the respective fine chemical produced in the process according to the invention. This improved production, or production efficiency, of the respective fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica* papaya, *Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis.*

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species *Saccharomyces cerevisiae* for the production of the respective fine chemical in microorganism.

The skilled worker knows other suitable sources for the production of respective fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*.

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

However, it is also possible to use artificial sequences, which differ in one or more bases from the nucleic acid sequences found in organisms, or in one or more amino acid molecules from polypeptide sequences found in organisms, in particular from the polypeptide sequences indicated in Table II, columns 5 or 7, lines 243 to 250 and 603 or the functional homologues thereof as described herein, preferably conferring above-mentioned activity, i.e. conferring a ferulic acid level increase after increasing the activity of the polypeptide sequences indicated in Table II, columns 5 or 7, lines 243, 244, 246, 247, 249 or conferring a sinapic acid level increase after increasing the activity of the polypeptide sequences indicated in Table II, columns 5 or 7, lines 245, 248 250 and 603.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as the pairs indicated in Table III, column 7, lines 243 to 250 and 603, by means of polymerase chain reaction can be generated on the basis of a sequence shown herein, for example the sequence as indicated in Table I, columns 5 or 7, lines 243 to 250 and 603, resp. or the sequences derived from a sequences as indicated in Table II, columns 5 or 7, lines 243 to 250 and 603, resp.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved region for the polypeptide of the invention are indicated in the alignments shown in the figures. Conserved regions are those, which show a very little variation in the amino acid in one particular position of several homologs from different origin. The consenus sequence shown in Table IV, column 7, lines 243 to 248, 250 and 603 is derived from said alignments.

Degenerated primers can then be utilized by PCR for the amplification of fragments of novel proteins having above-mentioned activity, e.g. conferring the increase of the respective fine chemical after increasing its expression or activity or further functional homologs of the polypeptide of the invention or the polypeptide used in the method of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis.

Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown herein below:

(1) Hybridization conditions can be selected, for example, from the following conditions:
 a) 4×SSC at 65° C.,
 b) 6×SSC at 45° C.,
 c) 6×SSC, 100 mg/ml denatured fragmented fish sperm DNA at 68° C.,
 d) 6×SSC, 0.5% SDS, 100 mg/ml denatured salmon sperm DNA at 68° C.,
 e) 6×SSC, 0.5% SDS, 100 mg/ml denatured fragmented salmon sperm DNA, 50% formamide at 42° C.,
 f) 50% formamide, 4×SSC at 42° C.,
 g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
 h) 2× or 4×SSC at 50° C. (low-stringency condition), or
 i) 30 to 40% formamide, 2× or 4×SSC at 42° C. (low-stringency condition).

(2) Wash steps can be selected, for example, from the following conditions:
 a) 0.015 M NaCl/0.0015 M sodium citrate/0.1% SDS at 50° C.
 b) 0.1×SSC at 65° C.
 c) 0.1×SSC, 0.5% SDS at 68° C.
 d) 0.1×SSC, 0.5% SDS, 50% formamide at 42° C.
 e) 0.2×SSC, 0.1% SDS at 42° C.
 f) 2×SSC at 65° C. (low-stringency condition).

Polypeptides having above-mentioned activity, i.e. conferring the respective fine chemical level increase, derived from other organisms, can be encoded by other DNA sequences which hybridise to a sequence indicated in Table I, columns 5 or 7, lines 243, 244, 246, 247, 249, preferably of Table I B, columns 5 or 7, lines 243, 244, 246, 247, 249 for ferulic acid or indicated in Table I, columns 5 or 7, lines 245, 248, 250, 603, preferably of Table I B, columns 5 or 7, lines 245, 248, 250, 603 for sinapic under relaxed hybridization conditions and which code on expression for peptides having the respective fine chemical, i.e. ferulic acid or sinapic acid, resp., increasing-activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the respective fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridising with the nucleic acid molecule of the invention or the nucleic acid molecule used in the method of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned activity, preferably conferring an increase in the respective fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences indicated in Table I, columns 5 or 7, lines 243 to 250 and 603, preferably of Table I B, columns 5 or 7, lines 243 to 250 and 603 is one which is sufficiently complementary to one of said nucleotide sequences such that it can hybridise to one of said nucleotide sequences, thereby forming a stable duplex. Preferably, the hybridisation is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence indicated in Table I, columns 5 or 7, lines 243 to 250 and 603, preferably of Table I B, columns 5 or 7, lines 243 to 250 and 603 or a portion thereof and preferably has above mentioned activity, in particular having a ferulic acid or sinapic acid increasing activity after increasing the activity or an activity of a product of a gene encoding said sequences or their homologs.

The nucleic acid molecule of the invention comprises a nucleotide sequence which hybridizes, preferably hybridizes under stringent conditions as defined herein, to one of the nucleotide sequences indicated in Table I, columns 5 or 7, lines 243 to 250 and 603, preferably of Table I B, columns 5 or 7, lines 243 to 250 and 603 or a portion thereof and encodes a protein having above-mentioned activity, e.g. conferring a of ferulic acid or sinapic acid increase, resp., and optionally, the activity of protein indicated in Table II, column 5, lines 243 to 250 and 603, preferably of Table II B, columns 5 or 7, lines 243 to 250 and 603.

Optionally, in one embodiment, the nucleotide sequence, which hybridises to one of the nucleotide sequences indicated in Table I, columns 5 or 7, lines 243 to 250 and 603, preferably of Table I B, columns 5 or 7, lines 243 to 250 and 603 has further one or more of the activities annotated or known for a protein as indicated in Table II, column 3, lines 243 to 250 and 603, preferably of Table II B, columns 5 or 7, lines 243 to 250 and 603.

Moreover, the nucleic acid molecule of the invention can comprise only a portion of the coding region of one of the sequences indicated in Table I, columns 5 or 7, lines 243 to 250 and 603, preferably of Table I B, columns 5 or 7, lines 243 to 250 and 603 for example a fragment which can be used as a probe or primer or a fragment encoding a biologically active portion of the polypeptide of the present invention or of a polypeptide used in the process of the present invention, i.e. having above-mentioned activity, e.g. conferring an increase of ferulic acid or sinapic acid, resp., if its activity is increased. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., as indicated in Table I, columns 5 or 7, lines 243 to 250 and 603, an anti-sense sequence of one of the sequences, e.g., as indicated in Table I, columns 5 or 7, lines 243 to 250 and 603, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primer pairs indicated in Table III, column 7, lines 243 to 250 and 603 will result in a fragment of a polynucleotide sequence as indicated in Table I, columns 5 or 7, lines 243 to 250 and 603 or its gene product. Preferred is Table II B, column 7, lines 243 to 250 and 603.

Primer sets are interchangeable. The person skilled in the art knows to combine said primers to result in the desired product, e.g. in a full-length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention encodes a polypeptide or portion thereof which includes an amino acid sequence which is sufficiently homologous to an amino acid sequence as indicated in Table II, columns 5 or 7, lines 243 to 250 and 603 such that the protein or portion thereof maintains the ability to participate in the respective fine chemical production, in particular a ferulic acid (lines 243, 244, 246, 247, 249) or sinapic acid (lines 245, 248, 250, 603) increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as indicated in Table II, columns 5 or 7, lines 243 to 250 and 603 such that the protein or portion thereof is able to participate in the increase of the respective fine chemical production. In one embodiment, a protein or portion thereof as indicated in Table II, columns 5 or 7, lines 243 to 250 and 603 has for example an activity of a polypeptide indicated in Table II, column 3, lines 243 to 250 and 603.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence as indicated in Table II, columns 5 or 7, lines 243 to 250 and 603 and has above-mentioned activity, e.g. conferring preferably the increase of the respective fine chemical.

Portions of proteins encoded by the nucleic acid molecule of the invention or the nucleic acid molecule used in the method of the invention are preferably biologically active, preferably having above-mentioned annotated activity, e.g. conferring a increase the respective fine chemical after increase of activity.

As mentioned herein, the term "biologically active portion" is intended to include a portion, e.g., a domain/motif, that confers increase of the respective fine chemical or has an immunological activity such that it is binds to an antibody binding specifically to the polypeptide of the present invention or a polypeptide used in the process of the present invention for producing the respective fine chemical;

The invention further relates to nucleic acid molecules that differ from one of the nucleotide sequences as indicated in Table I, columns 5 or 7, lines 243 to 250 and 603 (and portions thereof) due to degeneracy of the genetic code and thus encode a polypeptide of the present invention, in particular a polypeptide having above mentioned activity, e.g. conferring an increase in the respective fine chemical in a organism, e.g. as polypeptides comprising the sequence as indicated in Table IV, column 7, lines 243 to 248, 250 and 603 or as polypeptides depicted in Table II, columns 5 or 7, lines 243 to 250 and 603 or the functional homologues. Advantageously, the nucleic acid molecule of the invention comprises, or in an other embodiment has, a nucleotide sequence encoding a protein comprising, or in an other embodiment having, an amino acid sequence of a consensus sequences as indicated in Table IV, column 7, lines 243 to 248, 250 and 603 or of the polypeptide as indicated in Table II, columns 5 or 7, lines 243 to 250 and 603, resp., or the functional homologues. In a still further embodiment, the nucleic acid molecule of the invention encodes a full length protein which is substantially homologous to an amino acid sequence comprising a consensus sequence as indicated in Table IV, column 7, lines 243 to 248, 250 and 603 or of a polypeptide as indicated in Table II, columns 5 or 7, lines 243 to 250 and 603 or the functional homologues. However, in a preferred embodiment, the nucleic acid molecule of the present invention does not consist of a sequence as indicated in Table I, columns 5 or 7, lines 243 to 250 and 603, resp., preferably as indicated in Table I A, columns 5 or 7, lines 243 to 250 and/or 603. Preferably the nucleic acid molecule of the invention is a functional homologue or identical to a nucleic acid molecule indicated in Table I B, columns 5 or 7, lines 243 to 250 and/or 603.

In addition, it will be appreciated by those skilled in the art that DNA sequence polymorphisms that lead to changes in the amino acid sequences may exist within a population. Such genetic polymorphism in the gene encoding the polypeptide of the invention or the polypeptide used in the method of the invention or comprising the nucleic acid molecule of the invention or the nucleic acid molecule used in the method of the invention may exist among individuals within a population due to natural variation.

As used herein, the terms "gene" and "recombinant gene" refer to nucleic acid molecules comprising an open reading frame encoding the polypeptide of the invention or the polypeptide used in the method of the invention or comprising the nucleic acid molecule of the invention or the nucleic acid molecule used in the method of the invention or encoding the polypeptide used in the process of the present invention, preferably from a crop plant or from a microorganism useful for the production of respective fine chemicals, in particular for the production of the respective fine chemical. Such natural variations can typically result in 1-5% variance in the nucleotide sequence of the gene. Any and all such nucleotide variations and resulting amino acid polymorphisms in genes encoding a polypeptide of the invention or the polypeptide used in the method of the invention or comprising a the nucleic acid molecule of the invention or the nucleic acid molecule used in the method of the invention that are the result of natural variation and that do not alter the functional activity as described are intended to be within the scope of the invention.

Nucleic acid molecules corresponding to natural variants homologues of a nucleic acid molecule of the invention or the nucleic acid molecule used in the method of the invention, which can also be a cDNA, can be isolated based on their homology to the nucleic acid molecules disclosed herein using the nucleic acid molecule of the invention or the nucleic acid molecule used in the method of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising a sequence as indicated in Table I, columns 5 or 7, lines 243 to 250 and 603. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, a nucleic acid molecule of the invention that hybridizes under stringent conditions to a sequence as indicated in Table I, columns 5 or 7, lines 243 to 250 and 603 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the increase of the amount of the respective fine chemical in a organism or a part thereof, e.g. a tissue, a cell, or a compartment of a cell, after increasing the expression or activity thereof or the activity of a protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. as indicated in Table I, columns 5 or 7, lines 243 to 250 and 603, resp.

A "non-essential" amino acid residue is a residue that can be altered from the wild-type sequence of one without altering the activity of said polypeptide, whereas an "essential" amino acid residue is required for an activity as mentioned above, e.g. leading to an increase in the respective fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organism can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned activity, e.g. conferring an increase in the respective fine chemical in organisms or parts thereof that contain changes in amino acid residues that are not essential for said activity. Such polypeptides differ in amino acid sequence from a sequence contained in a sequence as indicated in Table II, columns 5 or 7, lines 243 to 250 and 603, resp., yet retain said activity described herein. The nucleic acid molecule can comprise a nucleotide sequence encoding a polypeptide, wherein the polypeptide comprises an amino acid sequence at least about 50% identical to an amino acid sequence as indicated in Table II, columns 5 or 7, lines 243 to 250 and 603, resp., and is capable of participation in the increase of production of the respective fine chemical after increasing its activity, e.g. its expression. Preferably, the protein encoded by the nucleic acid molecule is at least about 60% identical to a sequence as indicated in Table II, columns 5 or 7, lines 243 to 250 and 603, resp., more preferably at least about 70% identical to one of the sequences as indicated in Table II, columns 5 or 7, lines 243 to 250 and 603, resp., even more preferably at least about 80%, 90%, 95% homologous to a sequence as indicated in Table II, columns 5 or 7, lines 243 to 250 and 603, resp., and most preferably at least about 96%, 97%, 98%, or 99% identical to the sequence as indicated in Table II, columns 5 or 7, lines 243 to 250 and 603.

Accordingly, the invention relates to nucleic acid molecules encoding a polypeptide having above-mentioned activity, e.g. conferring an increase in the respective fine chemical in an organisms or parts thereof that contain changes in amino acid residues that are not essential for said activity. Such polypeptides differ in amino acid sequence from a sequence contained in a sequence as indicated in Table II, columns 5 or 7, lines 243 to 250 and 603, preferably of Table II B, column 7, lines 243 to 250 and 603 yet retain said activity described herein. The nucleic acid molecule can comprise a nucleotide sequence encoding a polypeptide, wherein the polypeptide comprises an amino acid sequence at least about 50% identical to an amino acid sequence as indicated in Table II, columns 5 or 7, lines 243 to 250 and 603, preferably of Table II B, column 7, lines 243 to 250 and 603 and is capable of participation in the increase of production of the respective fine chemical after increasing its activity, e.g. its expression. Preferably, the protein encoded by the nucleic acid molecule is at least about 60% identical to a sequence as indicated in Table II, columns 5 or 7, lines 243 to 250 and 603, preferably of Table II B, column 7, lines 243 to 250 and 603, more preferably at least about 70% identical to one of the sequences as indicated in Table II, columns 5 or 7, lines 243 to 250 and 603, preferably of Table II B, column 7, lines 243 to 250 and 603, even more preferably at least about 80%, 90%, or 95% homologous to a sequence as indicated in Table II, columns 5 or 7, lines 243 to 250 and 603, preferably of Table II B, column 7, lines 243 to 250 and 603, and most preferably at least about 96%, 97%, 98%, or 99% identical to the sequence as indicated in Table II, columns 5 or 7, lines 243 to 250 and 603, preferably of Table II B, column 7, lines 243 to 250 and 603.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in defines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence, which has 80% homology with sequence SEQ ID NO: 24071 at the nucleic acid level is understood as meaning a sequence which, upon comparison with the sequence SEQ ID NO: 24071 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2.912 | Average mismatch: | −2.003 |

For example a sequence which has a 80% homology with sequence SEQ ID NO: 24072 at the protein level is understood as meaning a sequence which, upon comparison with the sequence SEQ ID NO: 24072 by the above program algorithm with the above parameter set, has a 80% homology.

Functional equivalents derived from one of the polypeptides as indicated in Table II, columns 5 or 7, lines 243 to 250 and 603, resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table II, columns 5 or 7, lines 243 to 250 and 603, resp., according to the invention and are distinguished by essentially the same properties as a polypeptide as indicated in Table II, columns 5 or 7, lines 243 to 250 and 603, resp.

Functional equivalents derived from a nucleic acid sequence as indicated in Table I, columns 5 or 7, lines 243 to 250 and 603, resp., according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as indicated in Table II, columns 5 or 7, lines 243 to 250 and 603, resp., according to the invention and encode polypeptides having essentially the same properties as a polypeptide as indicated in Table II, columns 5 or 7, lines 243 to 250 and 603, resp.

"Essentially the same properties" of a functional equivalent is above all understood as meaning that the functional equivalent has above mentioned activity, e.g. conferring an increase in the respective fine chemical amount while increasing the amount of protein, activity or function of said functional equivalent in an organism, e.g. a microorganism, a plant or plant or animal tissue, plant or animal cells or a part of the same.

A nucleic acid molecule encoding a homologous to a protein sequence as indicated in Table II, columns 5 or 7, lines 243 to 250 and 603, resp., can be created by introducing one or more nucleotide substitutions, additions or deletions into a nucleotide sequence of the nucleic acid molecule of the present invention, in particular as indicated in Table I, columns 5 or 7, lines 243 to 250 and 603, resp., such that one or more amino acid substitutions, additions or deletions are introduced into the encoded protein. Mutations can be introduced into the encoding sequences as indicated in Table I, columns 5 or 7, lines 243 to 250 and 603, resp., by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the respective fine chemical.

Following mutagenesis of one of the sequences shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with a sequence as indicated in Table I, columns 5 or 7, lines 243 to 250 and 603, resp., or of the nucleic acid sequences derived from a sequences as indicated in Table II, columns 5 or 7, lines 243 to 250 and 603, preferably of Table II B, column 7, lines 243 to 250 and 603, resp., comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from a sequence as indicated in Table I, columns 5 or 7, lines 243 to 250 and 603, resp., or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises one or more sequences as indicated in Table I, columns 5 or 7, lines 243 to 250 and 603, preferably of Table I B, column 7, lines 243 to 250 and 603, resp. In one embodiment, it is preferred that the nucleic acid molecule comprises as little as possible other nucleotides not shown in any one of sequences as indicated in Table I, columns 5 or 7, lines 243 to 250 and 603, preferably of Table I B, column 7, lines 243 to 250 and 603, resp. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, a nucleic acid molecule used in the process of the invention is identical to a sequence as indicated in Table I, columns 5 or 7, lines 243 to 250 and 603, preferably of Table I B, column 7, lines 243 to 250 and 603, resp.

Also preferred is that one or more nucleic acid molecule(s) used in the process of the invention encodes a polypeptide comprising a sequence as indicated in Table II, columns 5 or 7, lines 243 to 250 and 603, preferably of Table II B, column 7, lines 243 to 250 and 603, resp. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment, the encoded polypeptide used in the process of the invention is identical to the sequences as indicated in Table II, columns 5 or 7, lines 243 to 250 and 603, preferably of Table II B, column 7, lines 243 to 250 and 603, resp.

In one embodiment, a nucleic acid molecule of the invention or used in the process encodes a polypeptide comprising the sequence as indicated in Table II, columns 5 or 7, lines 243 to 250 and 603, preferably of Table II B, column 7, lines 243 to 250 and 603, resp., comprises less than 100 further nucleotides. In a further embodiment, said nucleic acid molecule comprises less than 30 further nucleotides. In one embodiment, the nucleic acid molecule used in the process is identical to a coding sequence encoding a sequences as indicated in Table II, columns 5 or 7, lines 243 to 250 and 603, preferably of Table II B, column 7, lines 243 to 250 and 603, resp.

Polypeptides (=proteins), which still have the essential enzymatic activity of the polypeptide of the present invention conferring an increase of the respective fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as indicated in Table II, columns 5 or 7, lines 243 to 250 and 603, resp., and is expressed under identical conditions.

In one embodiment, the polypeptide of the invention is a homolog consisting or comprising the sequence as indicated in Table II B, column 7, lines 243 to 250 and 603, Homologues of a sequences as indicated in Table I, columns 5 or 7, lines 243 to 250 and 603, resp., or of a derived sequences as indicated in Table II, columns 5 or 7, lines 243 to 250 and 603, resp., also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3' regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound respective fine chemical produced by the selected mutated organisms or parts thereof.

The organisms or part thereof produce according to the herein mentioned process of the invention an increased level of free and/or -bound respective fine chemical compared to said control or selected organisms or parts thereof.

In one embodiment, the organisms or part thereof produce according to the herein mentioned process of the invention an increased level of protein-bound respective fine chemical compared to said control or selected organisms or parts thereof.

Advantageously the selected organisms are mutagenized according to the invention. According to the invention mutagenesis is any change of the genetic information in the genome of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectively. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene products are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, e.g. activate nearly all genes of an organism by the random integration of an activation construct. Afterwards the skilled worker can identify those mutagenized lines in which a gene of the invention has been activated, which in turns leads to the desired increase in the respective fine chemical production.

The genes of the invention can also be activated by mutagenesis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagenesis as well as the respective agents is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000) "Protocols in Mutagenesis", Elsevier Health Sciences]. As the skilled worker knows the spontaneous mutation rate in the cells of an organism is very low and that a large number of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagenesis with N-methyl-N-nitro-nitroso-guanidine.

Other biological method are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants which have increased antibiotic resistance.

In one embodiment, the protein according to the invention or the nucleic acid molecule characterized herein originates from a eukaryotic or prokaryotic organism such as a non-human animal, a plant, a microorganism such as a fungi, a yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention originate from bacteria, for example from Proteobacteria, in particular from Gammaproteobacteria, more preferred from Enterobacteriales, e.g. from the family Enterobacteriaceae, particularly from genera *Escherichia, Salmonella, Klebsiella*, advantageously form the species *Escherichia coli* K12.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism.

It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; Glycine max*; sunflower linseed or maize or their homologues.

Accordingly, in one embodiment, the invention relates to a nucleic acid molecule, which comprises a nucleic acid molecule selected from the group consisting of:

a) nucleic acid molecule encoding, preferably at least the mature form, of a polypeptide as indicated in Table II, columns 5 or 7, lines 243 to 250 and 603, preferably of Table II B, column 7, lines 243 to 250 and 603, resp.; or a fragment thereof conferring an increase in the amount of the respective fine chemical, i.e. ferulic acid (lines 243, 244, 246, 247, 249) or sinapic acid (lines 245, 248, 250, 603), resp., in an organism or a part thereof b) nucleic acid molecule comprising, preferably at least the mature form, of a nucleic acid molecule as indicated in Table I, columns 5 or 7, lines 243 to 250 and 603, preferably of Table I B, column 7, lines 243 to 250 and 603, resp., or a fragment thereof conferring an increase in the amount of the respective fine chemical in an organism or a part thereof;

c) nucleic acid molecule whose sequence can be deduced from a polypeptide sequence encoded by a nucleic acid molecule of (a) or (b) as result of the degeneracy of the genetic code and conferring an increase in the amount of the respective fine chemical in an organism or a part thereof;

d) nucleic acid molecule encoding a polypeptide whose sequence has at least 50% identity with the amino acid sequence of the polypeptide encoded by the nucleic acid molecule of (a) to (c) and conferring an increase in the amount of the respective fine chemical in an organism or a part thereof;

e) nucleic acid molecule which hybridizes with a nucleic acid molecule of (a) to (c) under stringent hybridisation conditions and conferring an increase in the amount of the respective fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the respective fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the respective fine chemical in an organism or a part thereof;

h) nucleic acid molecule comprising a nucleic acid molecule which is obtained by amplifying a cDNA library or a genomic library using primers or primer pairs as indicated in Table III, column 7, lines 243 to 250 and 603 and conferring an increase in the amount of the respective fine chemical, i.e. ferulic acid (lines 243, 244, 246, 247, 249) or sinapic acid (lines 245, 248, 250, 603), resp., in an organism or a part thereof;

i) nucleic acid molecule encoding a polypeptide which is isolated, e.g. from a expression library, with the aid of monoclonal antibodies against a polypeptide encoded by one of the nucleic acid molecules of (a) to (g), preferably to (a) to (c) and conferring an increase in the amount of the respective fine chemical in an organism or a part thereof;

j) nucleic acid molecule which encodes a polypeptide comprising a consensus sequence as indicated in Table IV, column 7, lines 243 to 248, 250 and 603 and conferring an increase in the amount of the respective fine chemical, i.e. ferulic acid (lines 243, 244, 246, 247, 249) or sinapic acid (lines 245, 248, 250, 603), resp., in an organism or a part thereof;

k) nucleic acid molecule encoding the amino acid sequence of a polypeptide encoding a domain of a polypeptide as indicated in Table II, columns 5 or 7, lines 243 to 250 and 603, preferably of Table II B, column 7, lines 243 to 250 and 603, resp., and conferring an increase in the amount of the respective fine chemical, i.e. ferulic acid (lines 243, 244, 246, 247, 249) or sinapic acid (lines 245, 248, 250, 603), resp., in an organism or a part thereof; and l) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of a nucleic acid molecule as indicated in Table I, columns 5 or 7, lines 243 to 250 and 603, resp., or a nucleic acid molecule encoding, preferably at least the mature form of, a polypeptide as indicated in Table II, columns 5 or 7, lines 243 to 250 and 603, resp., and conferring an increase in the amount of the respective fine chemical in an organism or a part thereof; or which encompasses a sequence which is complementary thereto;

whereby, preferably, the nucleic acid molecule according to (a) to (l) distinguishes over a sequence as indicated in Table IA or IB, columns 5 or 7, lines 243 to 250 and 603, resp., by one or more nucleotides. In one embodiment, the nucleic acid molecule of the invention does not consist of the sequence as indicated in Table IA or IB, columns 5 or 7, lines 243 to 250 and 603, resp. In an other embodiment, the nucleic acid molecule of the present invention is at least 30% identical and less than 100%, 99.999%, 99.99%, 99.9% or 99% identical to a sequence as indicated in Table IA or IB, columns 5 or 7, lines 243 to 250 and 603, resp. In a further embodiment the nucleic acid molecule does not encode a polypeptide sequence as indicated in Table IIA or IIB, columns 5 or 7, lines 243 to 250 and 603, resp. Accordingly, in one embodiment, the nucleic acid molecule of the present invention encodes in one embodiment a polypeptide which differs at least in one or more amino acids from a polypeptide indicated in Table IIA or IIB, columns 5 or 7, lines 243 to 250 and 603 does not encode a protein of a sequence as indicated in Table IIA or IIB, columns 5 or 7, lines 243 to 250 and 603. Accordingly, in one embodiment, the protein encoded by a sequences of a nucleic acid accoriding to (a) to (l) does not consist of a sequence as indicated in Table IIA or IIB, columns 5 or 7, lines 243 to 250 and 603. In a further embodiment, the protein of the present invention is at least 30% identical to a protein sequence indicated in Table IIA or IIB, columns 5 or 7, lines 243 to 250 and 603 and less than 100%, preferably less than 99.999%, 99.99% or 99.9%, more preferably less than 99%, 98%, 97%, 96% or 95% identical to a sequence as indicated in Table IIA or IIB, columns 5 or 7, lines 243 to 250 and 603.

The nucleic acid sequences used in the process are advantageously introduced in a nucleic acid construct, preferably an expression cassette which makes possible the expression of the nucleic acid molecules in an organism, advantageously a plant or a microorganism.

Accordingly, the invention also relates to an nucleic acid construct, preferably to an expression construct, comprising the nucleic acid molecule of the present invention functionally linked to one or more regulatory elements or signals.

As described herein, the nucleic acid construct can also comprise further genes, which are to be introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes, are genes of the glutamic acid metabolism, the phosphoenolpyruvate metabolism, the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:

(a) introducing of a nucleic acid construct comprising the nucleic acid molecule of the invention or used in the process of the invention or encoding the polypeptide of the present invention or used in the process of the invention; or
(b) introducing of a nucleic acid molecule, including regulatory sequences or factors, which expression increases the expression of the nucleic acid molecule of the invention or used in the process of the invention or encoding the polypeptide of the present invention or used in the process of the invention;
in a cell, or an organism or a part thereof, preferably in a plant, plant cell or a microorganism, and
(c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. Suitable cloning vectors are generally known to the skilled worker.

They include, in particular, vectors which are capable of replication in easy to handle cloning systems like as bacterial yeast or insect cell based (e.g. baculovirus expression) systems, that is to say especially vectors which ensure efficient cloning in E. coli, and which make possible the stable transformation of plants. Vectors, which must be mentioned in particular are various binary and cointegrated vector systems which are suitable for the T-DNA-mediated transformation. Such vector systems are generally characterized in that they contain at least the vir genes, which are required for the Agrobacterium-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in E. coli and in Agrobacterium. These binary vectors include vectors from the series pBIB-HYG, pPZP, pBecks, pGreen. Those which are preferably used in accordance with the invention are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included.

Usually, the plant transformation vector constructs according to the invention contain T-DNA sequences both from the right and from the left border region, which contain expedient recognition sites for site-specific acting enzymes which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Sacharomycetaceae, Saprolegniaceae, Schizosacharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus, Corynebacterium, Micrococcus, Brevibacterium, Rhodococcus, Nocardia, Caseobacter* or *Arthrobacter* or gram-negative bacteria such as the genera *Escherichia, Flavobacterium* or *Salmonella*, or yeasts such as the genera *Rhodotorula, Hansenula, Pichia, Yerrowia, Saccharomyces, Schizosaccharomyces* or *Candida*.

Host organisms which are especially advantageously selected in the process according to the invention are microorganisms selected from the group of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium* glutamigenes, *Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular *agrobacteria*, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent *agrobacteria* by means of electroporation or heat shock. In principle, one must differentiate between the formation of cointegrated vectors on the one hand and the transformation with binary vectors on the other hand. In the case of the firet alternative, the constructs, which comprise the codogenic gene segment or the nucleic acid molecule of the invention or the nucleic acid molecule used in the method of the invention have no T-DNA sequences, but the formation of the cointegrated vectors or constructs takes place in the *agrobacteria* by homologous recombination of the construct with T-DNA. The T-DNA is present in the *agrobacteria* in the form of Ti or Ri plasmids in which exogenous DNA has expediently replaced the oncogenes. If binary vectors are used, they can be transferred to *agrobacteria* either by bacterial conjugation or by direct transfer. These *agrobacteria* expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as *agrobacteria* or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed *agrobacteria* can be grown in the manner known per se and are thus available for the expedient transformation of the plants. The plants or plant parts to be transformed are grown or provided in the customary manner. The transformed *agrobacteria* are subsequently allowed to act on the plants or plant parts until a sufficient transformation rate is reached. Allowing the *agrobacteria* to act on the plants or plant parts can take different forms. For example, a culture of morphogenic plant cells or tissue may be used. After the T-DNA transfer, the bacteria are, as a rule, eliminated by antibiotics, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media.

The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to a sequence indicated in Table I, columns 5 or 7, lines 243 to 250 and 603 or its derivatives, it is advantageous to express and/or mutate further genes in the organisms. Especially advantageously, additionally at least one further gene of the glutamic acid or phosphoenolpyruvate metabolic pathway, is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the fine chemicals desired since, for example, feedback regulations no longer exist to the same extent or not at all. In addition it might be advantageously to combine one or more of the sequences indicated in Table I, columns 5 or 7, lines 243 to 250 and 603, resp., with genes which generally support or enhances to growth or yield of the target organismen, for example genes which lead to faster growth rate of microorganisms or genes which produces stress-, pathogen, or herbicide resistant plants.

Further advantageous nucleic acid sequences which can be expressed in combination with the sequences indicated in Table I, columns 5 or 7, lines 243 to 250 and 603 used in the process and/or the abovementioned biosynthesis genes are the sequences encoding further genes of the aromatic amino acid pathway, such as tryptophan, phenylalanine or tyrosine. These genes can lead to an increased synthesis of the essential amino acids tryptophan, phenylalanine or tyrosine.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the respective fine chemical is not impaired, or so that their specific enzymatic activity is increased. Less influence means in this connection that the regulation of the enzymic activity is less by at least 10%, advantageously at least 20, 30 or 40%, particularly advantageously by at least 50, 60, 70, 80 or 90%, compared with the starting organism, and thus the activity of the enzyme is increased by these figures mentioned compared with the starting organism. An increase in the enzymatic activity means an enzymatic activity which is increased by at least 10%, advantageously at least 20, 30, 40 or 50%, particularly advantageously by at least 60, 70, 80, 90, 100, 200, 300, 500 or 1000%, compared with the starting organism. This leads to an increased productivity of the desired respective fine chemical or of the desired respective fine chemicals.

In a further advantageous embodiment of the process of the invention, the organisms used in the process are those in which simultaneously a ferulic acid or sinapic acid degrading protein is attenuated, in particular by reducing the rate of expression of the corresponding gene. A person skilled in the art knows for example, that the inhibition or repression of a ferulic acid or sinapic acid degrading enzyme will result in an increased ferulic acid and/or sinapic acid accumulation in the plant.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or the nucleic acid molecule used in the method of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to to the coding sequence of the nucleic acid molecule of the invention or the nucleic acid molecule used in the method of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the Ω enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein activity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a NT-rich sequence which act as quantitative enhancers of gene expression in transgenic tobacco and potato plants (Sandhu et al., 1998; Plant Mol. Biol. 37(5):885-96). Beside that, a large variety of cis-active elements have been described which contribute to specific expression pattern, like organ specific expression or induced expression in response to biotic or abiotic stress. Examples are elements which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, lacI$^{q-}$, T7, T5, T3, gal, trc, ara, SP6, $\lambda$-P$_R$ or $\lambda$-P$_L$ promoter, which are advantageously used in Gram-negative bacteria. Further advantageous regulatory sequences are present for example in the Gram-positive promoters amy, dnaK, xylS and SPO2, in the yeast or fungal promoters ADC1, MF$\alpha$, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism are for example the fimA terminator, txn terminator or trp terminator. Such terminators can be rho-dependent or rho-independent.

Different plant promoters such as, for example, the USP, the LegB4–, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention or the nucleic acid molecule used in the method of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein.

This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination arepolyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell Targeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5):2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention in a plant can be advantageous. However, inducible expression of the polypeptide of the invention or the polypeptide used in the method of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of amino acids takes place, in seed cells, such as endosperm cells and cells of the developing embryo. Suitable promoters are the oilseed rape napin gene promoter (U.S. Pat. No. 5,608,152), the *Vicia faba* USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley Ipt2 or Ipt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the *Glycine max* phosphoribosylpyrophosphate amidotransferase promoter (GenBank Accession No. U87999) or the node-specific promoter described in EP-A-0 249 676.

Other promoters, which are particularly suitable, are those which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba, Trifolium repens* and *Vicia narbonensis*, vegetables and fruits, for example bananas, grapes, *Lycopersicon esculentum*, asparagus, cabbage, watermelons, kiwi fruit, *Solanum tuberosum, Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the invention comprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the respective fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signalsThese regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.:583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion *E. coli* expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage which harbors a T7 gn1 gene under the transcriptional control of the lacUV 5 promoter.

Other vectors which are suitable in prokaryotic organisms are known to the skilled worker; these vectors are for example in *E. coli* pLG338, pACYC184, the pBR series, such as pBR322, the pUC series such as pUC18 or pUC19, the M113 mp series, pKC30, pRep4, pHS1, pHS2, pPLc236, pMBL24, pLG200, pUR290, pIN-III[113]-B1, λgt11 or pBdCl, in *Streptomyces* pIJ101, pIJ364, pIJ702 or pIJ361, in *Bacillus* pUB110, pC194 or pBD214, in *Corynebacterium* pSA77 or pAJ667.

In a further embodiment, the expression vector is a yeast expression vector. Examples of vectors for expression in the yeasts *S. cerevisiae* encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 2 μM, pAG-1, YEp6, YEp13 or pEMBLYe23.

Further vectors, which may be mentioned by way of example, are pALS1, pIL2 or pBB116 in fungi or pLGV23, pGHlac+, pBIN19, pAK2004 or pDH51 in plants.

As an alternative, the nucleic acid sequences can be expressed in insect cells using baculovirus expression vectors. Baculovirus vectors, which are available for expressing proteins in cultured insect cells (for example Sf9 cells) encompass the pAc series (Smith et al. (1983) Mol. Cell. Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E.F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The respective fine chemical produced can be isolated from the organism by methods with which the skilled worker are familiar, for example via extraction, salt precipitation, and/or different chromatography methods. The process according to the invention can be conducted batchwise, semibatchwise or continuously.

In one embodiment, the present invention relates to a polypeptide encoded by the nucleic acid molecule according to the present invention, preferably conferring an increase in the respective fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with an eukaryotic organism as host cell. E.g., in one embodiment the polypeptide is produced in a plant cell or plant with a nucleic acid molecule derived from a prokaryote or a fungus or an alga or an other microorganism but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in E. coli there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, native polypeptide conferring the increase of the respective fine chemical in an organism or part thereof can be isolated from cells, for example using the antibody of the present invention as described below, e.g. an antibody against a protein as indicated in Table II, column 3, lines 243 to 250 and 603, resp., or an antibody against a polypeptide as indicated in Table II, columns 5 or 7, lines 243 to 250 and 603, resp., which can be produced by standard techniques utilizing the polypeptide of the present invention or fragment thereof. Preferred are monoclonal antibodies.

In one embodiment, the present invention relates to a polypeptide having the amino acid sequence encoded by a nucleic acid molecule of the invention or the nucleic acid molecule used in the method of the invention or obtainable by a process of the invention. Said polypeptide confers preferably the aforementioned activity, in particular, the polypeptide confers the increase of the respective fine chemical in a cell or an organism or a part thereof after increasing the cellular activity, e.g. by increasing the expression or the specific activity of the polypeptide.

In one embodiment, the present invention relates to a polypeptide having a sequence as indicated in Table II, columns 5 or 7, lines 243 to 250 and 603, resp., or as coded by a nucleic acid molecule as indicated in Table I, columns 5 or 7, lines 243 to 250 and 603, resp., or functional homologues thereof.

In one advantageous embodiment, in the method of the present invention the activity of a polypeptide is increased which comprises or consists of a consensus sequence as indicated in Table IV, column 7, lines 243 to 248, 250 and 603 and in one another embodiment, the present invention relates to a polypeptide comprising or consisting of a consensus sequence as indicated in Table IV, column 7, lines 243 to 248, 250 and 603 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

In one embodiment not more than 15%, preferably 10%, even more preferred 5%, 4%, 3%, or 2%, most preferred 1% or 0% of the amino acid position indicated by a letter are/is replaced another amino acid or, in an other embodiment, are/is absent and/or replaced. In another embodiment the stretches of non-conserved amino acids, indicated by $(X)_n$ [whereas n indicates the number of X], vary in their length by 20%, preferably by 15 or 10%, even more preferred by 5%, 4%, 3%, 2% or most preferred by only 1%.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence or, in an other embodiment, are absent and/or replaced.

The consensus sequence shown herein was derived from a multiple alignment of the sequences as listed in table II. The consensus sequences of specified domains were derived from a multiple alignment of all sequences. The letters represent the one letter amino acid code and indicate that the amino acids are conserved in all aligned proteins. The letter X stands for amino acids, which are not conserved in all sequences.

In one example, in the cases where only a small selected subset of amino acids are possible at a certain position these amino acids are given in brackets. The number of given X indicates the distances between conserved amino acid residues, e.g. YX(21-23)F means that conserved tyrosine and phenylalanine residues are separated from each other by minimum 21 and maximum 23 amino acid residues in all investigated sequences.

The alignment was performed with the Software AlignX (sept 25, 2002) a component of Vector NTI Suite 8.0, InforMax™, Invitrogen™ life science software, U.S. Main Office, 7305 Executive Way, Frederick, Md. 21704,USA with the following settings: For pairwise alignments: gap opening penality: 10.0; gap extension penality 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0,5; Consensus calculation options: Residue fraction for consensus: 0.9. Presettings were selected to allow also for the alignment of conserved amino acids.

In one advantageous embodiment, the method of the present invention comprises the increasing of a polypeptide comprising or consisting of plant or microorganism specific consensus sequences.

In one embodiment, said polypeptide of the invention distinguishes over a sequence as indicated in Table IIA or IIB, columns 5 or 7, lines 243 to 250 and 603, resp., by one or more amino acids. In one embodiment, polypeptide distinguishes from a sequence as indicated in Table IIA or IIB, columns 5 or 7, lines 243 to 250 and 603, resp., by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from a sequence as indicated in Table IIA or IIB, columns 5 or 7, lines 243 to 250 and 603, resp., by not more than 80% or 70% of the amino acids, preferably not more than 60% or 50%, more preferred not more than 40% or 30%, even more preferred not more than 20% or 10%. In an other embodiment, said polypeptide of the invention does not consist of a sequence as indicated in Table IIA or IIB, columns 5 or 7, lines 243 to 250 and 603.

In one embodiment, the polypeptide of the invention comprises any one of the sequences not known to the public before. In one embodiment, the polypeptide of the invention originates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to a polypeptide conferring an increase in the fine chemical in an organism or part being encoded by the nucleic acid molecule of the invention or by a nucleic acid molecule used in the process of the invention. In one embodiment, the polypeptide of the invention has a sequence which distinguishes from a sequence as indicated in Table IIA or IIB, columns 5 or 7, lines 243 to 250 and 603, resp., by one or more amino acids. In an other embodiment, said polypeptide of the invention does not consist of the sequence as indicated in Table IIA or IIB, columns 5 or 7, lines 243 to 250 and 603, resp. In a further embodiment, said polypeptide of the present invention is less than 100%, 99.999%, 99.99%, 99.9% or 99% identical. In one embodiment, said polypeptide does not consist of the sequence encoded by a nucleic acid molecules as indicated in Table IA or IB, columns 5 or 7, lines 243 to 250 and 603, resp.

In one embodiment, the present invention relates to a polypeptide having an activity of a protein as indicated in Table IIA or IIB, column 3, lines 243 to 250 and 603, resp., which distinguishes over a sequence as indicated in Table IIA or IIB, columns 5 or 7, lines 243 to 250 and 603, resp., by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, poly-peptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized.

The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention-chemicals, more preferably less than about 20% chemical precursors or non-polypeptide of the invention-chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

Non-polypeptide of the invention-chemicals are e.g. polypeptides having not the activity and/or the amino acid sequence of a polypeptide indicated in Table II, columns 3, 5 or 7, lines 243 to 250 and 603.

A polypeptide of the invention can participate in the process of the present invention. The polypeptide or a portion thereof comprises preferably an amino acid sequence which is sufficiently homologous to an amino acid sequence as indicated in Table II, columns 5 or 7, lines 243 to 250 and 603, resp. The portion of the protein is preferably a biologically active portion as described herein. Preferably, the polypeptide used in the process of the invention has an amino acid sequence identical to a sequence as indicated in Table II, columns 5 or 7, lines 243 to 250 and 603, resp.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the nucleotide sequence as indicated in Table I, columns 5 or 7, lines 243 to 250 and 603, resp. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence as indicated in Table I, columns 5 or 7, lines 243 to 250 and 603, resp., or which is homologous thereto, as defined above.

Accordingly the polypeptide of the present invention can vary from a sequence as indicated in Table II, columns 5 or 7, lines 243 to 250 and 603, resp., in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of as indicated in Table IIA or IIB, columns 5 or 7, lines 243 to 250 and 603, resp.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention or used in the process of the present invention, e.g., an amino acid sequence as indicated in Table II, columns 5 or 7, lines 243 to 250 and 603, resp., or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of a protein having essentially the activity of the polypeptides as indicated in Table II, column 3, lines 243 to 250 and 603 but having differences in the sequence from said wild-type protein. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention or the polypeptide used in the method of the invention may be utilized to generate plants or parts thereof, expressing one or more wildtype protein(s) or one or more mutated protein encoding nucleic acid molecule(s) or polypeptide molecule(s) of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition comprising the respective fine chemical or a recovered respective fine chemical, in particular, the fine chemical, free or in protein-bound form.

Preferably, the compound is a composition comprising the methionine or a recovered methionine, in particular, the fine chemical, free or in protein-bound form.

The invention also provides chimeric or fusion proteins.

As used herein, an "chimeric protein" or "fusion protein" comprises an polypeptide operatively linked to a polypeptide which does not confer above-mentioned activity, in particular, which does not confer an increase of content of the respective fine chemical in a cell or an organism or a part thereof, if its activity is increased.

In one embodiment, a reference to a protein (=polypeptide) of the invention or as indicated in Table II, columns 5 or 7, lines 243 to 250 and 603, resp., refers to a polypeptide having an amino acid sequence corresponding to the polypeptide of the invention or used in the process of the invention, whereas an "other polypeptide" not being indicated in Table II, columns 5 or 7, lines 243 to 250 and 603, resp., refers to a polypeptide having an amino acid sequence corresponding to a protein which is not substantially homologous to a polypeptide of the invention, preferably which is not substantially homologous to a polypeptide as indicated in Table II, columns 5 or 7, lines 243 to 250 and 603, resp., e.g., a protein which does not confer the activity described herein or annotated or known for as indicated in Table II, column 3, lines 243 to 250 and 603, resp., and which is derived from the same or a different organism. In one embodiment, an "other polypeptide" not being indicated in Table II, columns 5 or 7, lines 243 to 250 and 603, resp., does not confer an increase of the respective fine chemical in an organism or part thereof.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a polypeptide useful in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a polypeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention or the nucleic acid molecule used in the method of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modelling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996),1545-1558).

Furthermore, a three-dimensional and/or crystallographic structure of the protein of the invention and the identification of interactive sites the polypeptide of the invention or the polypeptide used in the method of the invention and its substrates or binding factors can be used for the identification or design of mutants with modulated binding or turn over activities. For example, the active centre of the polypeptide of the present invention can be modelled and amino acid residues participating in the catalytic reaction can be modulated to increase or decrease the binding of the substrate to activate or improve the polypeptide. The identification of the active centre and the amino acids involved in the catalytic reaction facilitates the screening for mutants having an increased activity.

The sequences shown in column 5 of the Tables I to IV herein have also been described under their Gene/ORF Locus Name as described in the Table I, II, III or IV, column 3.

In an especially preferred embodiment, the polypeptide according to the invention furthermore also does not have the sequences of those proteins which are encoded by the sequences shown in the known listed Gene/ORF Locus Names or as described in the Tables, column 3.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof. The "anti-sense strand" contains an inverted sequence, which is complementary to that of the "sense strand".

In addition the expression levels and/or the activity can be modified by the introduction of mutations in the regulatory or coding regions of the nucleic acids of the invention. Furthermore antibodies can be expressed which specifically binds to a polypeptide of interest and thereby blocks it activity. The protein-binding factors can, for example, also be aptamers [Famulok M and Mayer G (1999) Curr. Top Microbiol. Immunol. 243: 123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention or the nucleic acid molecule used in the method of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5'-UTR or 3'-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule to the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention or the nucleic acid molecule used in the method of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methyl-inosine, 2,2-dimethylguanine, 2-methyladenine, 2-methylguanine, 3-methylcytosine, 5-methylcytosine, N6-adenine, 7-methylguanine, 5-methylaminomethyluracil, 5-meth-oxyaminomethyl-2-thiouracil, beta-D-mannosylqueosine, 5'-methoxycarboxymethyl-uracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxy-acetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention or the polypeptide used in the method of the invention having aforementioned the respective fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention or the nucleic acid molecule used in the method of the invention can be an α-anomeric nucleic acid molecule. An α-anomeric nucleic acid molecule forms specific double-stranded hybrids with complementary RNA in which, contrary to the usual units, the strands run parallel to each other (Gaultier et al. (1987) *Nucleic Acids. Res.* 15:6625-6641). The antisense nucleic acid molecule can also comprise a 2'-o-methyl-ribonucleotide (Inoue et al. (1987) *Nucleic Acids Res.* 15:6131-6148) or a chimeric RNA-DNA analogue (Inoue et al. (1987) *FEBS Lett.* 215:327-330).

Further the antisense nucleic acid molecule of the invention or the nucleic acid molecule used in the method of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts encoding the polypeptide of the invention or the polypeptide used in the method of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or the nucleic acid molecule used in the method of the invention or coding a protein used in the process of the invention or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J.W. (1993) *Science* 261:1411-1418.

The antisense molecule of the present invention comprises also a nucleic acid molecule comprising a nucleotide sequences complementary to the regulatory region of an nucleotide sequence encoding the natural occurring polypeptide of the invention or the polypeptide used in the method of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) *Anticancer Drug Des.* 6(6): 569-84; Helene, C. et al. (1992) *Ann. N.Y. Acad. Sci.* 660:27-36; and Maher, L.J. (1992) *Bioassays* 14(12): 807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as *Neurospora, zebrafish, Drosophila*, mice, planaria, humans, *Trypanosoma, petunia* or *Arabidopsis* (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as *E. coli* for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of a nucleic acid sequences as indicated in Table I, columns 5 or 7, lines 243 to 250 and 603, resp., and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived there from), bring about altered metabolic activity by the reduction in the expression of a nucleic acid sequences as indicated in Table I, columns 5 or 7, lines 243 to 250 and 603, resp., and/or homologs thereof. In a double-stranded RNA molecule for reducing the expression of a protein encoded by a nucleic acid sequence as indicated in Table I, columns 5 or 7, lines 243 to 250 and 603, resp., and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in non-mammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1 000 copies per cell) may bring about more efficient reduction.

As has already been described, 100% sequence identity between the dsRNA and a gene transcript of a nucleic acid sequence as indicated in Table I, columns 5 or 7, lines 243 to 250 and 603, resp., or its homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence as indicated in Table I, columns 5 or 7, lines 243 to 250 and 603, resp., or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extra-cellularly (for example into the interstitial space).

Advantageously the RNAi method leads to only a partial loss of gene function and therefore enables the skilled worker to study a gene dose effect in the desired organism and to fine tune the process of the invention. Furthermore it enables a person skilled in the art to study multiple functions of a gene.

Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the respective fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M.W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S.D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). *Agrobacteria* transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S.D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with *Agrobacteria*, the transformants usually receive only a part of the vector, the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

*Agrobacteria* transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic (Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289). Alternative methods are based on the repeated removal of the influorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J and Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview can be taken from Bock (2001) Transgenic plastids in basic research and plant biotechnology. J Mol. Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22 (2), 225-229).

The genetically modified plant cells can be regenerated via all methods with which the skilled worker is familiar. Suitable methods can be found in the above-mentioned publications by S.D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the respective fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. the polypeptide as indicated in Table II, columns 5 or 7, lines 243 to 250 and 603, resp., e.g. encoding a polypeptide having protein activity, as indicated in Table II, columns 3, lines 243 to 250 and 603, resp. Due to the abovementioned activity the respective fine chemical content in a cell or an organism is increased. For example, due to modulation or manipulation, the cellular activity of the polypeptide of the invention or nucleic acid molecule of the invention is increased, e.g. due to an increased expression or specific activity of the subject matters of the invention in a cell or an organism or a part thereof.

Transgenic for a polypeptide having an activity of a polypeptide as indicated in Table II, columns 5 or 7, lines 243 to 250 and 603, resp., means herein that due to modulation or manipulation of the genome, an activity as annotated for a polypeptide as indicated in Table II, column 3, lines 243 to 250 and 603, e.g. having a sequence as indicated in Table II, columns 5 or 7, lines 243 to 250 and 603, resp., is increased in a cell or an organism or a part thereof. Examples are described above in context with the process of the invention.

"Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either
a) the nucleic acid sequence, or
b) a genetic control sequence linked operably to the nucleic acid sequence, for example a promoter, or
c) (a) and (b)
are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of a promoter of a gene encoding a polypeptide of the invention as indicated in Table II, column 3, lines 243 to 250 and 603, resp. with the corresponding protein-encoding sequence as indicated in Table I, column 5, lines 243 to 250 and 603, resp., becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the respective fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the respective fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant tissues or parts of plants originate from the under source organism mentioned plant families, preferably from the above-mentioned plant genus, more preferred from abovementioned plants species.

Transgenic plants comprising the respective fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. ferulic acid or sinapic acid, in particular the respective fine chemical, produced in the process according to the invention may, however, also be isolated from the plant in the form of their free ferulic acid or sinapic acid, in particular the free respective fine chemical, or bound in or to compounds or moieties, like glucosides, e.g. diglucosides. The respective fine chemical produced by this process can be harvested by harvesting the organisms either from the culture in which they grow or from the field. This can be done via expressing, grinding and/or extraction, salt precipitation and/or ion-exchange chromatography or other chromatographic methods of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention or the nucleic acid molecule used in the method of the invention.

In another embodiment, the present invention relates also to a transgenic microorganism comprising the nucleic acid molecule of the invention or the nucleic acid molecule used in the method of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process whereby the produced ferulic acid or sinapic acid is isolated.

In this manner, more than 50% by weight, advantageously more than 60% by weight, preferably more than 70% by weight, especially preferably more than 80% by weight, very especially preferably more than 90% by weight, of the ferulic acid or sinapic acid produced in the process can be isolated. The resulting ferulic acid or sinapic acid can, if appropriate, subsequently be further purified, if desired mixed with other active ingredients such as vitamins, amino acids, carbohydrates, antibiotics and the like, and, if appropriate, formulated.

In one embodiment, ferulic acid and sinapic are a mixture of the respective fine chemicals.

The ferulic acid or sinapic acid obtained in the process are suitable as starting material for the synthesis of further products of value. For example, they can be used in combination with each other or alone for the production of pharmaceuticals, foodstuffs, animal feeds or cosmetics. Accordingly, the present invention relates a method for the production of pharmaceuticals, food stuff, animal feeds, nutrients or cosmetics comprising the steps of the process according to the invention, including the isolation of the ferulic acid or sinapic acid composition produced or the respective fine chemical produced if desired and formulating the product with a pharmaceutical acceptable carrier or formulating the product in a form acceptable for an application in agriculture. A further embodiment according to the invention is the use of the ferulic acid or sinapic acid produced in the process or of the transgenic organisms in animal feeds, foodstuffs, medicines, food supplements, cosmetics or pharmaceuticals or for the production of ferulic acid or sinapic acid e.g. after isolation of the respective fine chemical or without, e.g. in situ, e.g in the organism used for the process for the production of the respective fine chemical.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus, Corynebacterium, Micrococcus, Brevibacterium, Rhodococcus, Nocardia, Caseobacter* or *Arthrobacter* or Gram-negative bacteria such as the genera *Escherichia, Flavobacterium* or *Salmonella* or yeasts such as the genera *Rhodotorula, Hansenula* or *Candida*. Particularly advantageous organisms are selected from the group of genera *Corynebacterium, Brevibacterium, Escherichia, Bacillus, Rhodotorula, Hansenula, Candida, Claviceps* or *Flavobacterium*. It is very particularly advantageous to use in the process of the invention microorganisms selected from the group of genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren and periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing sulfur-containing fine chemicals, in particular the respective fine chemical, e.g. amino acids containing sulfur it is possible to use as sulfur source inorganic sulfur-containing compounds such as, for example, sulfates, sulfites, dithionites, tetrathionates, thiosulfates, sulfides or else organic sulfur compounds such as mercaptans and thiols.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P.M. Rhodes, P.F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example, fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example, ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing in particular ferulic acid or sinapic acid in mixtures with other organic acids, aminoacids, polypeptides or polysaccarides, normally have a dry matter content of from 1 to 70% by weight, preferably 7.5 to 25% by weight. Sugar-limited fermentation is additionally advantageous, e.g. at the end, for example over at least 30% of the fermentation time. This means that the concentration of utilizable sugar in the fermentation medium is kept at, or reduced to, 0 to 10 g/l, preferably to 0 to 3 g/l during this time. The fermentation broth is then processed further. Depending on requirements, the biomass can be removed or isolated entirely or partly by separation methods, such as, for example, centrifugation, filtration, decantation, coagulation/flocculation or a combination of these methods, from the fermentation broth or left completely in it.

The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

Accordingly, it is possible to purify the ferulic acid or sinapic acid produced according to the invention further. For this purpose, the product-containing composition is subjected for example to separation via e.g. an open column chromatography or HPLC in which case the desired product or the impurities are retained wholly or partly on the chromatography resin. These chromatography steps can be repeated if necessary, using the same or different chromatography resins. The skilled worker is familiar with the choice of suitable chromatography resins and their most effective use.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention or the polypeptide used in the method of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavourings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 August; 10(4):382-6; Ma J K, Vine N D. Curr Top Microbiol Immunol. 1999; 236:275-92.

In one embodiment, the present invention relates to a method for the identification of a gene product conferring an increase in the respective fine chemical production in a cell, comprising the following steps:

(a) contacting e.g. hybridising, the nucleic acid molecules of a sample, e.g. cells, tissues, plants or microorganisms or a nucleic acid library, which can contain a candidate gene encoding a gene product conferring an increase in the respective fine chemical after expression, with the nucleic acid molecule of the present invention;

b. identifying the nucleic acid molecules, which hybridize under relaxed stringent conditions with the nucleic acid molecule of the present invention in particular to the nucleic acid molecule sequence as indicated in Table I, columns 5 or 7, lines 243 to 250 and 603, preferably in Table IB, columns 5 or 7, lines 243 to 250 and 603 resp., and, optionally, isolating the full length cDNA clone or complete genomic clone;

c. introducing the candidate nucleic acid molecules in host cells, preferably in a plant cell or a microorganism, appropriate for producing the respective fine chemical;

d. expressing the identified nucleic acid molecules in the host cells;

e. assaying the respective fine chemical level in the host cells; and f. identifying the nucleic acid molecule and its gene product which expression confers an increase in the respective fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In an other embodiment, the present invention relates to a method for the identification of a gene product conferring an increase in the respective fine chemical production in a cell, comprising the following steps:

(a) identifying nucleic acid molecules of an organism; which can contain a candidate gene encoding a gene product conferring an increase in the respective fine chemical after expression, which are at least 20%, preferably 25%, more preferably 30%, even more preferred are 35%. 40% or 50%, even more preferred are 60%, 70% or 80%, most preferred are 90% or 95% or more homology to the nucleic acid molecule of the present invention, for example via homology search in a data bank;
(b) introducing the candidate nucleic acid molecules in host cells, preferably in a plant cells or microorganisms, appropriate for producing the respective fine chemical;
(c) expressing the identified nucleic acid molecules in the host cells;
(d) assaying the respective fine chemical level in the host cells; and
(e) identifying the nucleic acid molecule and its gene product which expression confers an increase in the respective fine chemical level in the host cell after expression compared to the wild type.

Eventually gene products conferring the increase in the respective fine chemical production can also be identify according to a identical or similar 3D structure in step (a) and by the above described method.

The nucleic acid molecules identified can then be used for the production of the respective fine chemical in the same way as the nucleic acid molecule of the present invention. Accordingly, in one embodiment, the present invention relates to a process for the production of the respective fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the respective fine chemical to said plant comprising:
  a) contacting cells which express the polypeptide of the present invention or its mRNA with a candidate compound under cell cultivation conditions;
  b) assaying an increase in expression of said polypeptide or said mRNA;
  c) comparing the expression level to a standard response made in the absence of said candidate compound; whereby, an increased expression over the standard indicates that the compound is stimulating production of the respective fine chemical.

Furthermore, in one embodiment, the present invention relates to a method for the screening for agonists or an antagonist of the activity of the polypeptide of the present invention or used in the process of the present invention, e.g. a polypeptide conferring an increase of the respective fine chemical in an organism or a part thereof after increasing the activity in an organism or a part thereof, comprising:
  (a) contacting cells, tissues, plants or microorganisms which express the polypeptide according to the invention with a candidate compound or a sample comprising a plurality of compounds under conditions which permit the expression the polypeptide of the present invention or used in the process of the present invention;
  (b) assaying the respective fine chemical level or the polypeptide expression level in the cell, tissue, plant or microorganism or the media the cell, tissue, plant or microorganisms is cultured or maintained in; and
  (c) identifying a agonist or antagonist by comparing the measured the respective fine chemical level or polypeptide of the invention or used in the invention expression level with a standard the respective fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to process for the identification of a compound conferring increase of the respective fine chemical production in a plant or microorganism, comprising the steps:
(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and
(b) identifying if the compound is an effective agonist by detecting the presence or absence or increase of a signal produced by said readout system.

The screen for a gene product or an agonist conferring an increase in the respective fine chemical production can be performed by growth of an organism for example a microorganism in the presence of growth reducing amounts of an inhibitor of the synthesis of the respective fine chemical. Better growth, e.g. higher dividing rate or high dry mass in comparison to the control under such conditions would identify a gene or gene product or an agonist conferring an increase in respective fine chemical production.

One can think to screen for increased production of the respective fine chemical by for example searching for a resistance to a drug blocking the synthesis of the respective fine chemical and looking whether this effect is dependent on the activity or expression of a polypeptide as indicated in Table II, columns 5 or 7, lines 243 to 250 and 603 or a homolog thereof, e.g. comparing the phenotype of nearly identical organisms with low and high activity of a protein as indicated in Table II, columns 5 or 7, lines 243 to 250 and 603 after incubation with the drug.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the respective fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptide of the present invention can be generated by mutagenesis, e.g., discrete point mutation or truncation of the polypeptide of the present invention. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the respective fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the arm, e.g. buffers and solutions for hydridization assays, e.g. the aforementioned solutions and buffers, further and means for Southern-, Western-, Northern—etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the respective fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or the polypeptide used in the method of the invention or comprising the steps of the method according to the invention for the identification of said compound, agonist or antagonist; and formulating the nucleic acid molecule, the vector or the polypeptide of the invention or the polypeptide used in the method of the invention or the agonist, or compound identified according to the methods or processes of the present invention or with use of the subject matters of the present invention in a form applicable as plant agricultural composition.

In another embodiment, the present invention relates to a method for the production of a "the respective fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for the respective fine chemical production as mentioned and related organisms; mapping of genomes; identification and localization of sequences of interest; evolutionary studies; determination of regions required for function; modulation of an activity.

The nucleic acid molecule of the invention, the vector of the invention or the nucleic acid construct of the invention may also be useful for the production of organisms resistant to inhibitors of the ferulic acid or sinapic acid biosynthesis pathways. In particular, the overexpression of the polypeptide of the present invention may protect an organism such as a microorganism or a plant against inhibitors, which block the ferulic acid or sinapic acid synthesis.

Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention or the nucleic acid molecule used in the method of the invention may be sufficiently homologous to the sequences of related species such that these nucleic acid molecules may serve as markers for the construction of a genomic map in related organism.

Accordingly, the present invention relates to a method for breeding plants for the production of the respective fine chemical, comprising
   (a) providing a first plant variety produced according to the process of the invention preferably (over)expressing the nucleic acid molecule of the invention or the nucleic acid molecule used in the method of the invention;
   (b) crossing the first plant variety with a second plant variety; and
   (c) selecting the offspring plants which overproduce the respective fine chemical by means of analysis the distribution of a molecular marker in the offspring representing the first plant variety and its capability to (over)produce the respective fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334)

The molecular marker can e.g. relate to the nucleic acid molecule of the invention or the nucleic acid molecule used in the method of the invention and/or its expression level. Accordingly, the molecular marker can be a probe or a PCR primer set useful for identification of the genomic existence or genomic localisation of the nucleic acid molecule of the invention or the nucleic acid molecule used in the method of the invention, e.g. in a Southern blot analysis or a PCR or its expression level, i.e. in a Northern Blot analysis or a quantitative PCR.

Accordingly, in one embodiment, the present invention relates to the use of the nucleic acid molecule of the present invention or encoding the polypeptide of the present invention as molecular marker for breeding, especially for breeding for a high or low respective fine chemical production.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention or the nucleic acid molecule used in the method of the invention can be used for the identification of other nucleic acids conferring an increase of the respective fine chemical after expression.

Further, the nucleic acid molecule of the invention or the nucleic acid molecule used in the method of the invention or a fragment of a gene conferring the expression of the polypeptide of the invention or the polypeptide used in the method of the invention, preferably comprising the nucleic acid molecule of the invention, can be used for marker assisted breeding or association mapping of the respective fine chemical derived traits Accordingly, the nucleic acid of the invention, the polypeptide of the invention, the nucleic acid construct of the invention, the organisms, the host cell, the microorganisms, the plant, plant tissue, plant cell, or the part thereof of the invention, the vector of the invention, the agonist identified with the method of the invention, the nucleic acid molecule identified with the method of the present invention, can be used for the production of the respective fine chemical or of the respective fine chemical and one or more other organic acids. Accordingly, the nucleic acid of the invention, or the nucleic acid molecule identified with the method of the present invention or the complement sequences thereof, the polypeptide of the invention, the nucleic acid construct of the invention, the organisms, the host cell, the microorganisms, the plant, plant tissue, plant cell, or the part thereof of the invention, the vector of the invention, the antagonist identified with the method of the invention, the antibody of the present invention, the antisense molecule of the present invention, can be used for the reduction of the respective fine chemical in a organism or part thereof, e.g. in a cell.

Further, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, the antagonist or the agonist identified with the method of the invention, the antibody of the present invention, the antisense molecule of the present invention or the nucleic acid molecule identified with the method of the present invention, can be used for the preparation of an agricultural composition.

Furthermore, the nucleic acid of the invention, the polypeptide of the invention or the polypeptide used in the method of the invention, the nucleic acid construct of the invention, the organisms, the host cell, the microorganisms, the plant, plant tissue, plant cell, or the part thereof of the invention, the vector of the invention, antagonist or the agonist identified with the method of the invention, the antibody of the present invention, the antisense molecule of the present invention or the nucleic acid molecule identified with the method of the present invention, can be used for the identification and production of compounds capable of conferring a modulation of the respective fine chemical levels in an organism or parts thereof, preferably to identify and produce compounds conferring an increase of the respective fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet, for example under hftp://www.ncbi.nlm.nih.gov/PubMed/medline.html. Further databases and addresses, such as hftp://www.ncbi.nlm.nih.gov/, hftp://www.infobiogen.fr/, hftp://www.fmi.ch/biology/research-tools.html, hftp://www.tigr.org/, are known to the person skilled in the art and can also be obtained using, e.g., hftp://www.lycos.com. An overview of patent information in biotechnology and a survey of relevant sources of patent information useful for retrospective searching and for current awareness is given in Berks, TIBTECH 12 (1994), 352-364.

Table 1 gives an overview about the sequences disclosed in the present invention.

---

1) Increase of the metabolites:
   Max: maximal x-fold (normalised to wild type)-
   Min: minimal x-fold (normalised to wild type)
2) Decrease of the metabolites:
   Max: maximal x-fold (normalised to wild type)  (minimal decrease)
   Min: minimal x-fold (normalised to wild type)  (maximal decrease)

---

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning into in *Escherichia coli*

A DNA polynucleotide with a sequence as indicated in Table I, column 5 and encoding a polypeptide as listed in Table 1 below, was cloned into the plasmids pBR322 (Sutcliffe, J.G. (1979) Proc. Natl. Acad. Sci. USA, 75: 3737-3741); pACYC177 (Change & Cohen (1978) J. Bacteriol. 134: 1141-1156); plasmids of the pBS series (pBSSK+, pBSSK− and others; Stratagene, LaJolla, USA) or cosmids such as SuperCosi (Stratagene, LaJolla, USA) or Lorist6 (Gibson, T.J. Rosenthal, A., and Waterson, R.H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using AB1377 sequencers (see, for example, Fleischman, R. D. et al. (1995) "Whole-genome Random Sequencing and Assembly of *Haemophilus Influenzae* Rd., Science 269; 496-512)".

Example 3

In-Vivo and In-Vitro Mutagenesis

An in vivo mutagenesis of organisms such as *Saccharomyces, Mortierella, Escherichia* and others mentioned above, which are beneficial for the production of ferulic acid or sinapic acid can be carried out by passing a plasmid DNA (or another vector DNA) containing the desired nucleic acid sequence or nucleic acid sequences, e.g. the nucleic acid molecule of the invention or the vector of the invention, through *E. coli* and other microorganisms (for example *Bacillus* spp. or yeasts such as *Saccharomyces cerevisiae*) which are not capable of maintaining the integrity of its genetic information. Usual mutator strains have mutations in the genes for the DNA repair system [for example mutHLS, mutD, mutT and the like; for comparison, see Rupp, W.D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

In-vitro mutation methods such as increasing the spontaneous mutation rates by chemical or physical treatment are well known to the skilled person. Mutagens like 5-bromouracil, N-methyl-N-nitro-N-nitrosoguanidine (=NTG), ethyl methanesulfonate (=EMS), hydroxylamine and/or nitrous acid are widly used as chemical agents for random in-vitro mutagensis. The most common physical method for mutagensis is the treatment with UV irradiation. Another random mutagenesis technique is the error-prone PCR for introducing amino acid changes into proteins. Mutations are deliberately introduced during PCR through the use of error-prone DNA polymerases and special reaction conditions known to a person skilled in the art. For this method randomized DNA sequences are cloned into expression vectors and the resulting mutant libraries screened for altered or improved protein activity as described below.

Site-directed mutagensis method such as the introduction of desired mutations with an M13 or phagemid vector and short oligonucleotides primers is a well-known approach for site-directed mutagensis. The clou of this method involves cloning of the nucleic acid sequence of the invention into an M13 or phagemid vector, which permits recovery of single-stranded recombinant nucleic acid sequence. A mutagenic oligonucleotide primer is then designed whose sequence is perfectly complementary to nucleic acid sequence in the region to be mutated, but with a single difference: at the intended mutation site it bears a base that is complementary to the desired mutant nucleotide rather than the original. The mutagenic oligonucleotide is then allowed to prime new DNA synthesis to create a complementary full-length sequence containing the desired mutation. Another site-directed mutagensis method is the PCR mismatch primer mutagensis method also known to the skilled person. Dpnl site-directed mutagensis is a further known method as described for example in the Stratagene Quickchange™ site-directed mutagenesis kit protocol. A huge number of other methods are also known and used in common practice.

Positive mutation events can be selected by screening the organisms for the production of the desired respective fine chemical.

Example 4

DNA Transfer Between *Escherichia coli, Saccharomyces Cerevisiae* and *Mortierella alpina*

Shuttle vectors such as pYE22m, pPAC-ResQ, pClasper, pAUR224, pAMH10, pAML10, pAMT10, pAMU10, pGMH10, pGML10, pGMT10, pGMU10, pPGAL1, pPADH1, pTADH1, pTAex3, pNGA142, pHT3101 and derivatives thereof which allow the transfer of nucleic acid sequences between *Escherichia coli, Saccharomyces cerevisiae* and/or *Mortierella alpina* are available to the skilled worker. An easy method to isolate such shuttle vectors is disclosed by Soni R. and Murray J.A.H. [Nucleic Acid Research, vol. 20 no. 21, 1992: 5852]: If necessary such shuttle vectors can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons) and/or the aforementioned vectors, which have a replication origin for, and suitable marker from, *Escherichia coli, Saccharomyces cerevisiae* or *Mortierella alpina* added. Such replication origins are preferably taken from endogenous plasmids, which have been isolated from species used in the inventive process. Genes, which are used in particular as transformation markers for these species are genes for kanamycin resistance (such as those which originate from the Tn5 or Tn-903 transposon) or for chloramphenicol resistance (Winnacker, E.L. (1987) "From Genes to Clones—Introduction to Gene Technology", VCH, Weinheim) or for other antibiotic resistance genes such as for G418, gentamycin, neomycin, hygromycin or tetracycline resistance.

Using standard methods, it is possible to clone a gene of interest into one of the above-described shuttle vectors and to introduce such hybrid vectors into the microorganism strains used in the inventive process. The transformation of *Saccharomyces* can be achieved for example by LiCl or sheroplast transformation (Bishop et al., Mol. Cell. Biol., 6, 1986: 3401-3409; Sherman et al., Methods in Yeasts in Genetics, [Cold Spring Harbor Lab. Cold Spring Harbor, N.Y.] 1982, Agatep et al., Technical Tips Online 1998, 1:51: P01525 or Gietz et al., Methods Mol. Cell. Biol. 5, 1995: 255f) or electroporation (Delorme E., Appl. Environ. Microbiol., vol. 55, no. 9, 1989: 2242-2246).

If the transformed sequence(s) is/are to be integrated advantageously into the genome of the microorganism used in the inventive process for example into the yeast or fungi genome, standard techniques known to the skilled worker also exist for this purpose. Solinger et al. (Proc Natl Acad Sci USA., 2001 (15): 8447-8453) and Freedman et al. (Genetics, Vol. 162, 15-27, Sep. 2002,) teaches a homolog recombination system dependent on rad 50, rad51, rad54 and rad59 in yeasts. Vectors using this system for homologous recombination are vectors derived from the Ylp series. Plasmid vectors derived for example from the 2p-Vector are known by the skilled worker and used for the expression in yeasts. Other preferred vectors are for example pART1, pCHY21 or pEVP11 as they have been described by McLeod et al. (EMBO J. 1987, 6:729-736) and Hoffman et al. (Genes Dev. 5, 1991: 561-571.) or Russell et al. (J. Biol. Chem. 258, 1983: 143-149.). Other beneficial yeast vectors are plasmids of the REP, REP-X, pYZ or RIP series.

Example 5

Determining the Expression of the Mutant/Transgenic Protein

The observations of the activity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* or other microorganisms by a variety of methods, which are known in the art, e.g. as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or colorimetric marker, which can be detected readily. The presence and the observed amount of marker indicates the presence and the amount of the sought mutant protein in the cell. However, other methods are also known.

Example 6

Growth of Genetically Modified Organism: Media and Culture Conditions

Genetically modified Yeast, *Mortierella* or *Escherichia coli* are grown in synthetic or natural growth media known by the skilled worker. A number of different growth media for Yeast, *Mortierella* or *Escherichia coli* are well known and widely available. A method for culturing *Mortierella* is disclosed by Jang et al. [Bot. Bull. Acad. Sin. (2000) 41: 41-48]. *Mortierella* can be grown at 20° C. in a culture medium containing: 10 g/l glucose, 5 g/l yeast extract at pH 6.5. Furthermore Jang et al. teaches a submerged basal medium containing 20 g/l soluble starch, 5 g/l Bacto yeast extract, 10 g/l $KNO_3$, 1 g/l $KH_2PO_4$, and 0.5 g/l $MgSO_4.7H_2O$, pH 6.5.

Said media, which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as NH$_4$Cl, or (NH$_4$)$_2$SO$_4$, NH$_4$OH, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P.M. Rhodes, P.F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar and 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or NH$_4$OH. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated for example by introducing of a preculture of seed organisms.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E.C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N.C., Stevens, L. (1982) Fundamentals of Enzymology. Oxford Univ. Press: Oxford; Boyer, P.D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H.U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Analysis of the effect of the nucleic acid molecule on the production of ferulic acid or sinapic acid The effect of the genetic modification in plants, fungi, algae, ciliates or on the production of a desired compound (such as a ferulic acid or sinapic acid) can be determined by growing the modified microorganisms or the modified plant under suitable conditions (such as those described above) and analyzing the medium and/or the cellular components for the elevated production of desired product (i.e. of ferulic acid or sinapic acid). These analytical techniques are known to the skilled worker and comprise spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, p. 89-90 and p. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", p. 469-714, VCH: Weinheim; Belter, P. A., et al. (1988) Bioseparations: downstream processing for Biotechnology, John Wiley and Sons; Kennedy, J. F., and Cabral, J. M. S. (1992) Recovery processes for biological Materials, John Wiley and Sons; Shaeiwitz, J. A., and Henry, J. D. (1988) Biochemical Separations, in: Ullmann's Encyclopedia of Industrial Chemistry, Vol. B3; Chapter 11, p. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P.M. Rhodes and P.F. Stanbury, Ed. IRL Press, pp. 103-129; 131-163 and 165-192 (ISBN: 0199635773) and the references cited therein.

Example 9

Purification of Ferulic Acid or Sinapic Acid

Abbreviations; GC-MS, gas liquid chromatography/mass spectrometry; TLC, thin-layer chromatography.

The unambiguous detection for the presence of ferulic acid or sinapic acid can be obtained by analyzing recombinant organisms using analytical standard methods: LC, LC-MSMS or TLC, as described. The total amount produced in the organism for example in yeasts used in the inventive process can be analysed for example according to the following procedure:

The material such as yeasts, E. coli or plants to be analyzed can be disrupted by sonication, grinding in a glass mill, liquid nitrogen and grinding or via other applicable methods.

Plant material is initially homogenized mechanically by comminuting in a pestle and mortar to make it more amenable to extraction.

A typical sample pretreatment consists of a total lipid extraction using such polar organic solvents as acetone or alcohols as methanol, or ethers, saponification, partition between phases, seperation of non-polar epiphase from more polar hypophasic derivatives and chromatography.

For analysis, solvent delivery and aliquot removal can be accomplished with a robotic system comprising a single injector valve Gilson 232XL and a 402 2S1V diluter [Gilson, Inc. USA, 3000 W. Beltline Highway, Middleton, Wis.]. For saponification, 3 ml of 50% potassium hydroxide hydro-ethanolic solution (4 water-1 ethanol) can be added to each vial, followed by the addition of 3 ml of octanol. The saponification treatment can be conducted at room temperature with vials maintained on an IKA HS 501 horizontal shaker [Lab-world-online, Inc., Wilmington, N.C.] for fifteen hours at 250 movements/minute, followed by a stationary phase of approximately one hour.

Following saponification, the supernatant can be diluted with 0.17 ml of methanol. The addition of methanol can be conducted under pressure to ensure sample homogeneity. Using a 0.25 ml syringe, a 0.1 ml aliquot can be removed and transferred to HPLC vials for analysis.

For HPLC analysis, a Hewlett Packard 1100 HPLC, complete with a quaternary pump, vacuum degassing system, six-way injection valve, temperature regulated autosampler, column oven and Photodiode Array detector can be used [Agilent Technologies available through Ultra Scientific Inc., 250 Smith Street, North Kingstown, R.I.]. The column can be a Waters YMC30, 5-micron, 4.6×250 mm with a guard column of the same material [Waters, 34 Maple Street, Milford, Mass.]. The solvents for the mobile phase can be 81 methanol: 4 water: 15 tetrahydrofuran (THF) stabilized with 0.2% BHT (2,6-di-tert-butyl-4-methylphenol). Injections were 20 l. Separation can be isocratic at 30° C. with a flow rate of 1.7 ml/minute. The peak responses can be measured by absorbance at 447 nm.

If required and desired, further chromatography steps with a suitable resin may follow. Advantageously, the ferulic acid or sinapic acid can be further purified with a so-called RTH-PLC. As eluent acetonitrile/water or chloroform/acetonitrile mixtures can be used. If necessary, these chromatography steps may be repeated, using identical or other chromatography resins. The skilled worker is familiar with the selection of suitable chromatography resin and the most effective use for a particular molecule to be purified.

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 24071, 24083, 24177, 24353, 24865, 25117, 25357, 25361 or 92604 for the Expression in Plants Unless otherwise specified, standard methods as described in Sambrook et al., Molecular Cloning: A laboratory manual, Cold Spring Harbor 1989, Cold Spring Harbor Laboratory Press are used.

SEQ ID NO: 24071, 24083, 24177, 24353, 24865, 25117, 25357, 25361 or 92604 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of Saccharomyces cerevisiae (strain S288C; Research Genetics, Inc., now Invitrogen) or Escherichia coli (strain MG1655; E. coli Genetic Stock Center), 50 pmol forward primer, 50 pmol reverse primer, 2.5 u Pfu Turbo DNA polymerase. The amplification cycles were as follows:

1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C. The composition for the protocol of the Herculase polymerase was as follows: 1×PCR buffer (Stratagene), 0.2 mM of each dNTP, 100 ng genomic DNA of Saccharomyces cerevisiae (strain S288C; Research Genetics, Inc., now Invitrogen) or Escherichia coli (strain MG1655; E. coli Genetic Stock Center), 50 pmol forward primer, 50 pmol reverse primer, 2.5 u Herculase polymerase. The amplification cycles were as follows:

1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

In case the Herculase enzyme can be used for the amplification, the PCR amplification cycles were as follows: 1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID NO: 24071:
i) forward primer (SEQ ID NO: 24081)
atgcgtgctt taccgatctg ttta
ii) reverse primer (SEQ ID NO: 24082)
ttatttcgcc gtaatgttaa gcgcag The following primer sequences were selected for the gene SEQ ID NO: 24083:
i) forward primer (SEQ ID NO: 24175)
atgggacaca agcccttata ccg
ii) reverse primer (SEQ ID NO: 24176)
ttatcgcgat gattttcgct gcg The following primer sequences were selected for the gene SEQ ID NO: 24177:
i) forward primer (SEQ ID NO: 24351)
atgagtcgtt tagtcgtagt atcta
ii) reverse primer (SEQ ID NO: 24152)
ttacgcaagc tttggaaagg tagc The following primer sequences were selected for the gene SEQ ID NO: 24353:
i) forward primer (SEQ ID NO: 24863)
atgagtaaga tttttgaaga taac
ii) reverse primer (SEQ ID NO: 24864)
ttactgttgc aattctttct cagtg The following primer sequences were selected for the gene SEQ ID NO: 24865:
i) forward primer (SEQ ID NO: 25115)
atggaaaccg tggcttacgc tg
ii) reverse primer (SEQ ID NO: 24116)
ttatacgacg cgtacgcccg c The following primer sequences were selected for the gene SEQ ID NO: 25117:
i) forward primer (SEQ ID NO: 25355)
atgacgacga ttctcaagca tctc
ii) reverse primer (SEQ ID NO: 25356)
ttactggcct ttgttttcca gattc The following primer sequences were selected for the gene SEQ ID NO: 25357:
i) forward primer (SEQ ID NO: 25359)
atgtaccaaa ataatgtatt gaatgct
ii) reverse primer (SEQ ID NO: 25360)
tcaatagtgc attaactctc ccatt The following primer sequences were selected for the gene SEQ ID NO: 25361:
i) forward primer (SEQ ID NO: 25495)
atggagacca attttccctt cgact
ii) reverse primer (SEQ ID NO: 25496)
ctattgaaat accggcttca atattt The following primer sequences were selected for the gene SEQ ID NO: 92604:
i) forward primer (SEQ ID NO: 92658)
atggtaaagg aacgtaaaac cgagt
ii) reverse primer (SEQ ID NO: 92659)
ttaccctaaa tccgccatca acac Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector. The PCR-products, produced by Pfu Turbo DNA polymerase, were phosphorylated using a T4 DNA polymerase using a standard protocol (e.g. MBI Fermentas) and cloned into the processed binary vector.

The PCR-products, produced by Pfu Turbo DNA polymerase, were phosphorylated using a T4 DNA polymerase using a standard protocol (e.g. MBI Fermentas) and cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well. The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were phosphorylated using a T4 DNA polymerase using a standard protocol (e.g. MBI Fermentas) and cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID NO:24071, 24083, 24177, 24353, 24865, 25117, 25357, 25361 or 92604

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000) "A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The *agrobacteria* generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E.V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1 000 seeds per dish. The dishes were covered with a hood and placed in the stratification facility (8 h, 110µ, µmol/m²/s⁻¹, 22° C.; 16 h, dark, 6° C.). After 5 days, the dishes were placed into the short-day controlled environment chamber (8 h 130 µmol/m²/s⁻¹, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 µE, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 µl Silwett L77 (Crompton S.A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, Germany). After a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures <−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the described changes in comparison with wild-types were caused by the introduced genes.

As an alternative, ferulic acid can be detected as described in Mattila, P. and Kumpulainen J., J. Agric Food Chem. 2002 Jun. 19; 50(13):3660-7.

As an alternative, sinapic acid can be detected as described in Noda, M. and Matsumoto, M., Biochim Biophys Acta. 1971 Feb. 2; 231(1):131-3.

The results of the different plant analyses can be seen from the table 1 which follows:

TABLE 1

| ORF | Metabolite | Method | Min | Max |
|---|---|---|---|---|
| b0196 | Ferulic acid | LC | 1.10 | 1.25 |
| b0730 | Ferulic acid | LC | 1.38 | 1.97 |
| b1896 | Sinapic Acid | GC | 1.38 | 1.98 |
| b2414 | Ferulic acid | LC | 1.34 | 1.86 |
| b3074 | Ferulic acid | LC | 1.35 | 1.73 |
| b3172 | Sinapic Acid | GC | 1.31 | 1.89 |
| YBR184W | Ferulic acid | LC | 1.30 | 1.37 |
| YDR513W | Sinapic Acid | GC | 1.30 | 1.39 |
| b2818 | Sinapic Acid | GC | 1.27 | 1.54 |

Column 2 shows the metabolite ferulic acid or sinapic acid analyzed. Columns 4 and 5 shows the ratio of the analyzed metabolite between the transgenic plants and the wild type; Increase of the metabolite: Max: maximal x-fold (normalised to wild type)-Min: minimal x-fold (normalised to wild type). Decrease of the metabolite: Max: maximal x-fold (normalised to wild type) (minimal decrease), Min: minimal x-fold (normalised to wild type) (maximal decrease). Column 3 indicates the analytical method.

Column 3 shows the metabolite/respective fine chemical analyzed. Columns 4 and 5 shows the ratio of the analyzed metabolite/respective fine chemical between the transgenic plants and the wild type; Increase of the metabolites: Max: maximal x-fold (normalised to wild type)-Min: minimal x-fold (normalised to wild type). Decrease of the metabolites: Max: maximal x-fold (normalised to wild type) (minimal decrease), Min: minimal x-fold (normalised to wild type) (maximal decrease). Column 6 indicates the analytical method.

When the analyses were repeated independently, all results proved to be significant.

Example 14a

Engineering Ryegrass Plants by Over-Expressing the Polynucleotide Characterized in the Invention, e.g. Derived from *Saccharomyces cerevisiae*, *E. Coli* or Plants or an Other Organism Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 µm in size) are coated with plasmid DNA according to method of Sanford et al., 1993 and are delivered to the embryogenic callus with the following parameters: 500 µg particles and 2 µg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14b

Engineering Soybean Plants by Over-Expressing the Polynucleotide Characterized in the Invention, e.g. Derived from *Saccharomyces cerevisiae*, *E. Coli* or Plants or Another Organism Soybean can be transformed according to the following modification of the method described in the Texas A&M patent U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 µE–m–2s–1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1 agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing the Polynucleotide Characterized in the Invention, e.g. Derived from *Saccharomyces cerevisiae*, *E. Coli* or Plants or Another Organism Amplification of for example SEQ ID NO: 1 was achieved as described in example 10 except that the upstream primer SEQ ID NO:3 and the reverse primer SEQ ID NO: 4 contained the following 5"extensions:
  i) forward primer: 5"-GGGTCGCTCCTACGCG-3" SEQ ID NO: 68243
  ii) reverse primer 5"-CTCGGGCTCGGCGTCC-3" SEQ ID NO: 68246
Vector Construction The maize transformation vector for constitutive expression was constructed as follows.

As base vectors, the vectors EG073qcz (SEQ ID NO 68240) and EG065qcz (SEQ ID NO: 68241) were chosen. The MCS from EG065qcz was deleted by digestion of the vector with Asp718 and PstI, followed by blunting of the vector using T4 DNA polymerase. The blunted vector was religated. The vector generated was called EG065-MCS. The LIC cassette was cloned in the vector EG065-MCS by hybridizing the following oligos, generating a DNA fragment with ends able to ligate into a SmaI and SacI digested vector. This fragment was ligated into the vector EG065-MCS that had been digested with SmaI and SacI. The generated vector was called EG065-LIC. The complete expression cassette comprising ScBV (Schenk (1999) Plant Mol Biol 39(6):1221-1230) promoter, LIC cassette and terminator was cut out of EG065-LIC with AscI and PacI and ligated into the vector EG073qcz that had previously been digested with AscI and PacI. The resulting binary vector for corn transformation was called pMME0607 (SEQ ID NO: 68242).
Oligo POCCLicMluISacIIfw: gggtcgctcctacgcgtcaatgatc-cgcggacgccgagcccgagct (SEQ ID NO: 68244)
Oligo POCCLicMluISacIrev: cgggctcggcgtccgcggatcat-tgacgcgtaggagcgaccc (SEQ ID NO: 68245)

For cloning of a polynucleotide of the invention, for example the ORF of SEQ ID NO: 1, from *S. cerevisiae* the vector DNA was treated with the restriction enzyme MluI and SacII. The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing SEQ ID NO: 1.

The reaction was stopped by addition of high-salt buffer and purified over QIAquick columns following the standard protocol (Qiagen).

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin ( ) and incubated overnight at 37° C.

The plasmid preparation was carried out as specified in the Qiaprep standard protocol (Qiagen).

Example 14c.a

Corn Transformation

The preparation of the immature embryos and *Agrobacterium* were basically as stated in U.S. Pat. No. 5,591,616. In brief, the *Agrobacterium* strain LBA4404 transformed with the plasmid by a standard method, such as the triple cross method or the electroporation, was grown on LB plates for 2 days prior to cocultivation. A loop of cells was resuspended in liquid infection media at an O.D. of approximately 1.0. Immature Embryos of about 1.5 mm in size were incubated in the soln of *agrobacterium* for around 30 minutes. Excised embryos were removed from liquid and then co-cultivated in the dark at 22° C. with *Agrobacterium tumefaciens* on solid MS-based callus induction medium containing 2 mg/l 2, 4-D, 10 um AgNO3, and 200 um Acetosyringone. After several days of co-cultivation, embryos were transferred to MS-based media containing 2 mg/l 2, 4, 10 um AgNO3 and 200 mg/l Timentin in the dark at 27° C. for 1 week. Embryos were transferred to MS-based selection media containing imidazoline herbicide (500 nM Pursuit) as a selection agent in the dark for 3 weeks. After 3 weeks putative transgenic events were transferred to an MS-based media containing 2 mg/L Kinetin 500 nM Pursuit, 200 mg/l Timentin and incubated under cool white fluorescent light (100 µE/m2/s−1 with photoperiod of 16 hrs) at 25° C. for 2-3 weeks, or until shoots develop. The shoots were transferred to MS-based rooting medium and incubated under light at 25° C. for 2 weeks. The rooted shoots were transplanted to 4 inch pots containing artificial soil mix. Metro-Mix® 360 in and grown in an environmental chamber for 1-2 weeks. The environmental chamber maintained 16-h-light, 8-h-dark cycles at 27° C. day and 22° C. respectively. Light was supplied by a mixture of incandescent and cool white fluorescent bulbs with an intensity of ~400 uE/m2/s−1. After plants were grown to 4-6 leaf stage they were moved to 14 inch pots containing Metro-Mix® 360. Supplemental metal-halide lamps were used to maintain >800uE/m2/s−1 with a 16-h-light, 8-h-dark cycles at 28° C. day and 22° C. Transplantation occurs weekly on Tuesday. Peters 20-20-20 plus micronutrients (200 ppm) is used to fertilize plants 2× weekly on Monday and Thursday after sampling of T0's is performed. T1 seeds were produced from plants that exhibit tolerance to the imidazolinone herbicides and which are PCR positive for the transgenes. T0 plants with single locus insertions of the T-DNA (self-pollinated) produced T1 generation that segregated for the transgene in a 3:1 ratio. Progeny containing copies of the transgene were tolerant of imidazolinone herbicides and could be detected by PCR analysis.

Example 14c.b

Growth of T0 Corn Plants for Metabolic Analysis

Plants were grown under the following standardized conditions to properly stage them for T0 sampling. T0 plantlets were transferred to 14" pots in the greenhouse after they grow to 4-6 leaf stage (1-3 weeks). pBSMM232 containing plants were produced carried along with each experiment to serve as controls for T0 samples. Plantlets were moved to 14" pots on Tuesday of each week. Plants were grown for 9 days until the 7-13 leaf stage is reached. On Thursday between 10 am and 2 pm leaf sampling was performed on the 3rd youngest ($1^{st}$ fully elongated). Within 30 seconds 250-500 mg of leaf material (without midrib), were removed weighed and placed into pre-extracted glass thimbles in liquid nitrogen. A second sample (opposite side of the midrib) from each plant was sampled as described above for qPCR analysis.

Example 14c.c

Growth of T1 Corn Plant for Metabolic Analysis

For the bioanalytical analyses of the transgenic plants, the latter were grown uniformly in a specific culture facility. To this end the GS-90 substrate as the compost mixture was introduced into the potting machine (Laible System GmbH, Singen, Germany) and filled into the pots. Thereafter, 26 pots were combined in one dish and treated with Previcur. For the treatment, 25 ml of Previcur were taken up in 10 l of tap water. This amount was sufficient for the treatment of approximately 150 pots. The pots were placed into the Previcur solution and additionally irrigated overhead with tap water without Previcur. They were used within four days.

For the sowing, the seeds, which had been stored at room temperature were removed from the paper-bag and transferred into the pots with the soil. In total, approximately 1 to 3 seeds were distributed in the middle of the pot.

After the seeds had been sown, the dishes with the pots were covered with matching plastic hood and placed into growth chambers for 2 days. After this time the plastic hood was removed and plants were placed on the growth table and cultivated for 22 to 24 days under following growth conditions: 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s−1.

When the plants were 7 days old, they were subjected to select transgenic plants. For this purposes pieces of plant leaves were sampled and a PCR reaction with the respective primers for the transgene were performed. Plants exhibiting the transgene were used for the metabolic analysis. The non-transgenic seedlings were removed. The transgenic plants were thinned when they had reached the age of 18 days. The transgenic plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 24 days, they were harvested.

Example 14c.d

Metabolic Analysis of Maize Leaves

The modifications identified in accordance with the invention, in the content of above-described metabolites, were identified by the following procedure.

a) Sampling and Storage of the Samples

Sampling was performed in corridor next to the green house. The leaves were incised twice using small laboratory scissors and this part of the leave was removed manually from the middle rib. The sample was rapidly weighed on laboratory scales, transferred into a pre-cooled extraction sleeve and placed into kryo-box cooled by liquid nitrogen. The time elapsing between cutting the leave to freezing it in liquid nitrogen amounted to not more than 30 seconds. The boxes were stored in a freezer at −80° C., an shipped on dry ice.

b) Lyophilization

During the experiment, care was taken that the plants either remained in the deep-frozen state (temperatures <−40° C.) or were freed from water by lyophilization until the first contact with solvents. Before entering the analytical process the extraction sleeves with the samples were transferred to a pre-cooled aluminium rack.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nona-decanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at least at 1 400 g in order to accelerate phase separation. 0.5 ml of the supernatant methanol/water phase ("polar phase", colorless) was removed for the further GC analysis, and 0.5 ml was removed for the LC analysis. The remainder of the methanol/water phase of all samples was used for additional quality controls. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 μl of chloroform, 37 μl of hydrochloric acid (37% by weight HCl in water), 320 μl of methanol and 20 μl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (20 mg/ml in pyridine, 100 μl for 1.5 hours at 60° C.) in a tightly sealed vessel. 20 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 μl of N-methyl-N-(trimethylsilyl)-2,2,2-trifluoroacetamide (MSTFA) was carried out for 30 minutes at 60° C., again in the tightly sealed vessel. The final volume before injection into the GC was 220 μl.

f) Derivatization of the Polar Phase for the GC/MS Analysis

The methoximation of the carbonyl groups was carried out by reaction with methoxyamine hydrochloride (20 mg/ml in pyridine, 50 μl for 1.5 hours at 60° C.) in a tightly sealed vessel. 10 μl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 μl of N-methyl-N-(trimethylsilyl)-2,2,2-trifluoroacetamide (MSTFA) was carried out for 30 minutes at 60° C., again in the tightly sealed vessel. The final volume before injection into the GC was 110 μl.

g) Analysis of the Various Plant Samples

The samples were measured in individual series of 20 plant (leaf) samples each (also referred to as sequences), each sequence containing at least 5 samples from individual control plants containing GUS. The peak area of each analyte was divided by the peak area of the respective internal standard. The data were standardized for the fresh weight established for the respective harvested sample. The values calculated were then related to the GUS-containing control group by being divided by the mean of the corresponding data of the control group of the same sequence. The values obtained were referred to as ratio_by_WT, they are comparable between sequences and indicate how much the analyte concentration in the mutant differs in relation to the control. The GUS-containing plants were chosen in order to assure that the vector and transformation procedure itself has no significant influence on the metabolic composition of the plants. Therefore the described changes in comparison with the controls were caused by the introduced genes.

Transformation of maize (*Zea Mays* L.) can also be performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673 can be used to provide constitutive expression of the trait gene.

Excised embryos can be grown on callus induction medium, then maize regeneration medium, containing imidazolinone as a selection agent. The Petri plates can be incubated in the light at 25° C. for 2-3 weeks, or until shoots develop. The green shoots can be transferred from each embryo to maize rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which can be PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants can exhibited similar phenotypes as the T1 plants. Hybrid plants (F1 progeny) of homozygous transgenic plants and non-transgenic plants can also exhibit increased similar phenotypes.

Example 14d

Engineering Wheat Plants by Over-Expressing the Polynucleotide Characterized in the Invention, e.g. Derived from *Saccharomyces cerevisiae, E. Coli* or Plants or Another Organism Transformation of wheat can be performed with the method described by Ishida et al. (1996 Nature Biotech. 14745-50). The cultivar Bobwhite (available from CYMMIT, Mexico) can commonly be used in transformation. Immature embryos can be co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

After incubation with *Agrobacterium*, the embryos can be grown on callus induction medium, then regeneration medium, containing imidazolinone as a selection agent. The Petri plates can be incubated in the light at 25° C. for 2-3 weeks, or until shoots develop. The green shoots can be transferred from each embryo to rooting medium and incubated at 25° C. for 2-3 weeks, until roots develop. The rooted shoots can be transplanted to soil in the greenhouse. T1 seeds can be produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene can be tolerant of the imidazolinone herbicide. Homozygous T2 plants exhibited similar phenotypes.

Example 14e

Engineering Rapeseed/Canola Plants by Over-Expressing the Polynucleotide Characterized in the Invention, e.g. Derived from *Saccharomyces cerevisiae, E. coli* or Plants or Another Organism Cotyledonary petioles and hypocotyls of 5-6 day-old young seedlings can be used as explants for tissue culture and transformed according to Babic et al. (1998, Plant Cell Rep 17: 183-188). The commercial cultivar Westar (Agriculture Canada) can be the standard variety used for transformation, but other varieties can be used.

*Agrobacterium tumefaciens* LBA4404 containing a binary vector can be used for canola transformation. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767, 366 and 6,225,105). Similarly, various promoters can be used to regulate the trait gene to provide constitutive, developmental, tissue or environmental regulation of gene transcription. The 34S promoter (GenBank Accession numbers M59930 and X16673) can be used to provide constitutive expression of the trait gene.

Canola seeds can be surface-sterilized in 70% ethanol for 2 min., and then in 30% Clorox with a drop of Tween-20 for 10 min, followed by three rinses with sterilized distilled water. Seeds can be then germinated in vitro 5 days on half strength MS medium without hormones, 1% sucrose, 0.7% Phytagar at 23° C., 16 hr. light. The cotyledon petiole explants with the cotyledon attached can be excised from the in vitro seedlings, and can be inoculated with *Agrobacterium* by dipping the cut end of the petiole explant into the bacterial suspension. The explants can be then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants can be transferred to MSBAP-3 medium containing 3 mg/l BAP, cefotaxime, carbenicillin, or timentin (300 mg/l) for 7 days, and can then be cultured on MSBAP-3 medium with cefotaxime, carbenicillin, or timentin and selection agent until shoot regeneration. When the shoots are 5-10 mm in length, they can be cut and transferred to shoot elongation medium (MSBAP-0.5, containing 0.5 mg/l BAP). Shoots of about 2 cm in length can be transferred to the rooting medium (MS0) for root induction.

Samples of the primary transgenic plants (T0) can be analyzed by PCR to confirm the presence of T-DNA. These results can be confirmed by Southern hybridization in which DNA is electrophoresed on a 1 agarose gel and are transferred to a positively charged nylon membrane (Roche Diagnostics). The PCR DIG Probe Synthesis Kit (Roche Diagnostics) can be used to prepare a digoxigenin-labelled probe by PCR, and used as recommended by the manufacturer.

Example 14f

Engineering Alfalfa Plants by Over-Expressing the Polynucleotide Characterized in the Invention, e.g. Derived from *Saccharomyces cerevisiae* or *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) can be selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette can consist of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. The 34S promoter (GenBank Accession numbers M59930 and X16673) can be used to provide constitutive expression of the trait gene.

The explants can be cocultivated for 3 d in the dark on SH induction medium containing 288 mg/L Pro, 53 mg/L thioproline, 4.35 g/L K2SO4, and 100 µm acetosyringinone. The explants can be washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos can be transferred to BOi2Y development medium containing no growth regulators, no antibiotics, and 50 g/L sucrose. Somatic embryos are subsequently germinated on half-strength Murashige-Skoog medium. Rooted seedlings can be transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing the Polynucleotide Characterized in the Invention, Derived e.g. From *Saccharomyces cerevisiae*, *E. Coli* or Plants or Another Organism A regenerating clone of alfalfa (*Medicago sativa*) can be transformed using the method of (McKersie et al., 1999 Plant Physiol 119: 839-847). Regeneration and transformation of alfalfa can be genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants can be cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland KMA and MR Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 16

Preparation of Homologous Sequences from Plants

Different plants can be grown under standard or varying conditions in the greenhouse. RNA can be extracted following the protocol of Jones, Dunsmuir and Bedbrook (1985) EMBO J. 4: 2411-2418. Approx. 1 gram of tissue material from various organs is ground in liquid nitrogen. The powder is transferred to a 13 ml Falcon tube containing 4.5 ml NTES buffer (100 mM NaCl, 10 mM Tris/HCl pH 7.5, 1 mM EDTA, 1% SDS; in RNase-free water) and 3 ml phenol/chloroform/isoamylalcohol (25/24/1), immediately mixed and stored on ice. The mixture is spun for 10 minutes at 7000 rpm using a centrifuge (Sorval; SM24 or SS34 rotor). The supernatant is transferred to a new tube, 1/10th volume of 3 M NaAcetate (pH 5.2; in RNase-free water) and 1 volume of isopropanol is added, mixed at stored for 1 hour or overnight at −20° C. The mixture is spun for 10 minutes at 7000 rpm. The supernatant is discarded and the pellet washed with 70% ethanol (v/v). The mixture is spun for 5 minutes at 7000 rpm, the supernatant is discarded and the pellet is air-dried. 1 ml RNase-free water is added and allow the DNA/RNA pellet to dissolve on ice at 4 C. The nucleic acid solution is transferred to a 2 ml Eppendorf tube and 1 ml of 4 M LiAcetate is added. After mixing the solution is kept for at least 3 hours, or overnight, at 4 C. The mixture is spun for 10 minutes at 14000 rpm, the supernatant discarded, the pellet washed with 70% Ethanol, air-dried and dissolved in 200 μl of RNase-free water.

Total RNA can be used to construct a cDNA-library according to the manufacturer's protocol (for example using the ZAP-cDNA synthesis and cloning kit of Stratagene, La Jolla, USA). Basically, messenger RNA (mRNA) is primed in the first strand synthesis with a oligo(dT) linker—primer and is reverse-transcribed using reverse transcriptase. After second strand cDNA synthesis, the double-stranded cDNA is ligated into the Uni-ZAP XR vector. The Uni-ZAP XR vector allows in vivo excision of the pBluescript phagemid. The polylinker of the pBluescript phagemid has 21 unique cloning sites flanked by T3 and T7 promoters and a choice of 6 different primer sites for DNA sequencing. Systematic single run sequencing of the expected 5 prime end of the clones can allow preliminary annotation of the sequences for example with the help of the pedant pro Software package (Biomax, München). Clones for the nucleic acids of the invention or used in the process according to the invention can be identified based on homology search with standard algorithms like blastp or gap. Identified putative full length clones with identity or high homology can be subjected to further sequencing in order to obtain the complete sequence.

Additional new homologous sequences can be identified in a similar manner by preparing respective cDNA libraries from various plant sources as described above. Libraries can then be screened with available sequences of the invention under low stringency conditions for example as described in Sambrook et al., Molecular Cloning: A laboratory manual, Cold Spring Harbor 1989, Cold Spring Harbor Laboratory Press. Purified positive clones can be subjected to the in vivo excision and complete sequencing. A pairwise sequence alignment of the original and the new sequence using the blastp or gap program allows the identification of orthologs, meaning homologous sequences from different organisms, which should have a sequence identity of at least 30%. Furthermore the conservation of functionally important amino acid residues or domains, which can be identified by the alignment of several already available paralogs, can identify a new sequence as an new orthologs.

Alternatively libraries can be subjected to mass sequencing and obtained sequences can be stored in a sequence database, which then can be screened for putative orthologs by different search algorithms, for example the tbastn algorithm to search the obtained nucleic acid sequences with a amino acid sequence of the invention. Clones with the highest sequence identity are used for a complete sequence determination and orthologs can be identified as described above.

Item 1. A process for the production of ferulic acid or sinapic acid, which comprises
  (a) increasing or generating the activity of a protein as indicated in Table II, columns 5 or 7, lines 243 to 250 and 603 or a functional equivalent thereof in a non-human organism or in one or more parts thereof; and
  (b) growing the organism under conditions which permit the production of ferulic acid or sinapic acid in said organism.

Item 2. A process for the production of ferulic acid or sinapic acid, comprising the increasing or generating in an organism or a part thereof the expression of at least one nucleic acid molecule comprising a nucleic acid molecule selected from the group consisting of:
  a) nucleic acid molecule encoding of a polypeptide as indicated in Table II, columns 5 or 7, lines 243 to 250 and 603 or a fragment thereof, which confers an increase in the amount of ferulic acid or sinapic acid in an organism or a part thereof;
  b) nucleic acid molecule comprising of a nucleic acid molecule as indicated in Table I, columns 5 or 7, lines 243 to 250 and 603;
  c) nucleic acid molecule whose sequence can be deduced from a polypeptide sequence encoded by a nucleic acid molecule of (a) or (b) as a result of the degeneracy of the genetic code and conferring an increase in the amount of ferulic acid or sinapic acid in an organism or a part thereof;
  d) nucleic acid molecule which encodes a polypeptide which has at least 50% identity with the amino acid sequence of the polypeptide encoded by the nucleic acid molecule of (a) to (c) and conferring an increase in the amount of ferulic acid or sinapic acid in an organism or a part thereof;
  e) nucleic acid molecule which hybidizes with a nucleic acid molecule of (a) to (c) under stringent hybridisation conditions and conferring an increase in the amount of ferulic acid or sinapic acid in an organism or a part thereof;
  f) nucleic acid molecule which encompasses a nucleic acid molecule which is obtained by amplifying nucleic acid molecules from a cDNA library or a genomic library using the primers or primer pairs as indicated in Table III, column 7, lines 243 to 250 and 603 and conferring an increase in the amount of ferulic acid or sinapic acid in an organism or a part thereof;

g) nucleic acid molecule encoding a polypeptide which is isolated with the aid of monoclonal antibodies against a polypeptide encoded by one of the nucleic acid molecules of (a) to (f) and conferring an increase in the amount of ferulic acid or sinapic acid in an organism or a part thereof;

h) nucleic acid molecule encoding a polypeptide comprising a consensus as indicated in Table IV, column 7, lines 243 to 250 and 603 and conferring an increase in the amount of ferulic acid or sinapic acid in an organism or a part thereof; and i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of ferulic acid or sinapic acid in an organism or a part thereof.

or comprising a sequence which is complementary thereto.

Item 3. The process of item 1 or 2, comprising recovering of the free or bound ferulic acid or sinapic acid.

Item 4. The process of any one of item 1 to 3, comprising the following steps:
  a) selecting an organism or a part thereof expressing a polypeptide encoded by the nucleic acid molecule characterized in item 2;
  b) mutagenizing the selected organism or the part thereof;
  c) comparing the activity or the expression level of said polypeptide in the mutagenized organism or the part thereof with the activity or the expression of said polypeptide of the selected organisms or the part thereof;
  d) selecting the mutated organisms or parts thereof, which comprise an increased activity or expression level of said polypeptide compared to the selected organism or the part thereof;
  e) optionally, growing and cultivating the organisms or the parts thereof; and
  f) recovering, and optionally isolating, the free or bound ferulic acid or sinapic acid produced by the selected mutated organisms or parts thereof.

Item 5. The process of any one of items 1 to 4, wherein the activity of said protein or the expression of said nucleic acid molecule is increased or generated transiently or stably.

Item 6. An isolated nucleic acid molecule comprising a nucleic acid molecule selected from the group consisting of:
  a) nucleic acid molecule encoding of a polypeptide as indicated in Table II, columns 5 or 7, lines 243 to 250 and 603 or a fragment thereof, which confers an increase in the amount of ferulic acid or sinapic acid in an organism or a part thereof;
  b) nucleic acid molecule comprising of a nucleic acid molecule as indicated in Table I, columns 5 or 7, lines 243 to 250 and 603;
  c) nucleic acid molecule whose sequence can be deduced from a polypeptide sequence encoded by a nucleic acid molecule of (a) or (b) as a result of the degeneracy of the genetic code and conferring an increase in the amount of ferulic acid or sinapic acid in an organism or a part thereof;
  d) nucleic acid molecule which encodes a polypeptide which has at least 50% identity with the amino acid sequence of the polypeptide encoded by the nucleic acid molecule of (a) to (c) and conferring an increase in the amount of ferulic acid or sinapic acid in an organism or a part thereof;
  e) nucleic acid molecule which hybridizes with a nucleic acid molecule of (a) to (c) under r stringent hybridization conditions and conferring an increase in the amount of ferulic acid or sinapic acid in an organism or a part thereof;
  f) nucleic acid molecule which encompasses a nucleic acid molecule which is obtained by amplifying nucleic acid molecules from a cDNA library or a genomic library using the primers or primer pairs as indicated in Table III, column 7, lines 243 to 250 and 603 and conferring an increase in the amount of ferulic acid or sinapic acid in an organism or a part thereof;
  g) nucleic acid molecule encoding a polypeptide which is isolated with the aid of monoclonal antibodies against a polypeptide encoded by one of the nucleic acid molecules of (a) to (f) and conferring an increase in the amount of ferulic acid or sinapic acid in an organism or a part thereof;
  h) nucleic acid molecule encoding a polypeptide comprising a consensus as indicated in Table IV, column 7, lines 243 to 250 and 603 and conferring an increase in the amount of in an organism or a part thereof; and
  i) nucleic acid molecule which is obtainable by screening a suitable nucleic acid library under stringent hybridization conditions with a probe comprising one of the sequences of the nucleic acid molecule of (a) to (k) or with a fragment thereof having at least 15 nt, preferably 20 nt, 30 nt, 50 nt, 100 nt, 200 nt or 500 nt of the nucleic acid molecule characterized in (a) to (k) and conferring an increase in the amount of ferulic acid or sinapic acid in an organism or a part thereof.
  whereby the nucleic acid molecule distinguishes over the sequence as indicated in Table IA, columns 5 or 7, lines 243 to 250 and 603 by one or more nucleotides.

Item 7. A nucleic acid construct which confers the expression of the nucleic acid molecule of item 6, comprising one or more regulatory elements.

Item 8. A vector comprising the nucleic acid molecule as defined defined in item 6 or the nucleic acid construct of item 7.

Item 9. The vector as defined in item 8, wherein the nucleic acid molecule is in operable linkage with regulatory sequences for the expression in a prokaryotic or eukaryotic, or in a prokaryotic and eukaryotic, host.

Item 10. A host cell, which has been transformed stably or transiently with the vector as defined in item 8 or 9 or the nucleic acid molecule as defined in item 6 or the nucleic acid construct of item 7 or produced as described in item any one of items 2 to 5.

Item 11. The host cell of item 10, which is a transgenic host cell.

Item 12. The host cell of item 10 or 11, which is a plant cell, an animal cell, a microorganism, or a yeast cell, a fungus cell, a prokaryotic cell, an eukaryotic cell or an archaebacterium.

Item 13. A process for producing a polypeptide, wherein the polypeptide is expressed in a host cell as defined in any one of items 10 to 12.

Item 14. A polypeptide produced by the process as defined in item 13 or encoded by the nucleic acid molecule as defined in item 6 whereby the polypeptide distinguishes over a sequence as indicated in Table IIA, columns 5 or 7, lines 243 to 250 and 603 by one or more amino acids.

Item 15. An antibody, which binds specifically to the polypeptide as defined in item 14.

Item 16. A plant tissue, propagation material, harvested material or a plant comprising the host cell as defined in item 12 which is plant cell or an *Agrobacterium*.

Item 17. A method for screening for agonists and antagonists of the activity of a polypeptide encoded by the nucleic acid molecule of item 6 conferring an increase in the amount of ferulic acid or sinapic acid in an organism or a part thereof comprising:
 (a) contacting cells, tissues, plants or microorganisms which express the a polypeptide encoded by the nucleic acid molecule of item 6 conferring an increase in the amount of ferulic acid or sinapic acid in an organism or a part thereof with a candidate compound or a sample comprising a plurality of compounds under conditions which permit the expression the polypeptide;
 (b) assaying the ferulic acid or sinapic acid level or the polypeptide expression level in the cell, tissue, plant or microorganism or the media the cell, tissue, plant or microorganisms is cultured or maintained in; and
 (c) identifying a agonist or antagonist by comparing the measured ferulic acid or sinapic acid level or polypeptide expression level with a standard ferulic acid or sinapic acid or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Item 18. A process for the identification of a compound conferring increased ferulic acid or sinapic acid production in a plant or microorganism, comprising the steps:
 a) culturing a plant cell or tissue or microorganism or maintaining a plant expressing the polypeptide encoded by the nucleic acid molecule of item 6 conferring an increase in the amount of ferulic acid or sinapic acid in an organism or a part thereof and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of item 6 conferring an increase in the amount of ferulic acid or sinapic acid in an organism or a part thereof;
 b) identifying if the compound is an effective agonist by detecting the presence or absence or increase of a signal produced by said readout system.

Item 19. A method for the identification of a gene product conferring an increase in ferulic acid or sinapic acid production in a cell, comprising the following steps:
 a) contacting the nucleic acid molecules of a sample, which can contain a candidate gene encoding a gene product conferring an increase in ferulic acid or sinapic acid after expression with the nucleic acid molecule of item 6;
 b) identifying the nucleic acid molecules, which hybridise under relaxed stringent conditions with the nucleic acid molecule of item 6;
 c) introducing the candidate nucleic acid molecules in host cells appropriate for producing ferulic acid or sinapic acid;
 d) expressing the identified nucleic acid molecules in the host cells;
 e) assaying the ferulic acid or sinapic acid level in the host cells; and
 f) identifying nucleic acid molecule and its gene product which expression confers an increase in the ferulic acid or sinapic acid level in the host cell in the host cell after expression compared to the wild type.

Item 20. A method for the identification of a gene product conferring an increase in ferulic acid or sinapic acid production in a cell, comprising the following steps:
 a) identifiying in a data bank nucleic acid molecules of an organism; which can contain a candidate gene encoding a gene product conferring an increase in the ferulic acid or sinapic acid amount or level in an organism or a part thereof after expression, and which are at least 20% homolog to the nucleic acid molecule of item 6;
 b) introducing the candidate nucleic acid molecules in host cells appropriate for producing ferulic acid or sinapic acid;
 c) expressing the identified nucleic acid molecules in the host cells;
 d) assaying the ferulic acid or sinapic acid level in the host cells; and
 e) identifying nucleic acid molecule and its gene product which expression confers an increase in the ferulic acid or sinapic acid level in the host cell after expression compared to the wild type.

Item 21. A method for the production of an agricultural composition comprising the steps of the method of any one of items 17 to 20 and formulating the compound identified in any one of items 17 to 20 in a form acceptable for an application in agriculture.

Item 22. A composition comprising the nucleic acid molecule of item 6, the polypeptide of item 14, the nucleic acid construct of item 7, the vector of any one of items 8 or 9, an antagonist or agonist identified according to item 17, the compound of item 18, the gene product of item 19 or 20, the antibody of item 15, and optionally an agricultural acceptable carrier.

Item 23. Use of the nucleic acid molecule as defined in item 6 for the identification of a nucleic acid molecule conferring an increase of ferulic acid or sinapic acid after expression.

Item 24. Use of the polypeptide of item 14 or the nucleic acid construct item 7 or the gene product identified according to the method of item 19 or 20 for identifying compounds capable of conferring a modulation of ferulic acid or sinapic acid levels in an organism.

Item 25. Agrochemical, pharmaceutical, food or feed composition comprising the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 16, the host cell of item 10 to 12 or the gene product identified according to the method of item 19 or 20.

Item 26. The method of any one of items 1 to 5, the nucleic acid molecule of item 6, the polypeptide of item 14, the nucleic acid construct of item 7, the vector of item 8 or 9, the antagonist or agonist identified according to item 17, the antibody of item 15, the plant or plant tissue of item 16, the harvested material of item 16, the host cell of item 10 to 12 or the gene product identified according to the method of item 19 or 20, wherein the fine chemical is ferulic acid or sinapic acid.

The present invention relates to a process for the production of the fine chemical in a microorganism, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagation material, harvested material, plants, microorganisms as well as agricultural compositions and to their use.

SEQUENCE LISTING (108484 sequences)

SEQ ID NO: 1 - DNA, 1612 bp, Saccharomyces cerevisiae
  CDS (167)..(1330)
tgtggtagtacgagttttttctccgcaatctcggagttagtgcagccgcgcccgctgctgcaccctttagcatatatataaagtgcgtaatgtgcgtgctaaaaaagctcactagtgcgtactctgcttatctctgcgtatccgccgatcaacatccgcggctaaaatggaacagaacaggttcaagaaagaaacgaaaacttgtagcgctagctggccgcgcgcaccgcagtcgacgctgtgtgcgacagatcgcctcgagctcacatacgatgtgtacactagcgcagagcggcaacgccgctctcgcactgccactaggcttaaccttgtgtttttgcacggcagcggcatgagtaaggtggtatgggagtactatttgccgcgtctggtagccgccgatgcggagggcaattatgccatcgacaaggttttgttgatcgaccaggttaaccacggtgattctgcggtacgcaaccgcggcagactcggcaccaatttcaactggatcgacggggcccgcgacgtgctcaagattgccacatgcgagttgggcagtattgacagccacccggcactaaacgtagtcatcggccactcgatgggcgggttccaggctcttgcgtgtgacgtcctgcagcccaatctgtttcatttgctcatcttgatcgagcctgtagtaatcacacggaaagccatcggcgccgggaggccagggcttccgcccgattctccgcagatcccagaaaatctttataactccctacgtttaaagacgtgcgaccatttcgctaacgagtccgaatatgtaaaatatatgaggaacggttccttttttaccaatgcgcacagccaaatcctgcaaaacatcatcgattttgagaggacaaaagcctctggagacgatgaagatggtggacccgttcgcacgaagatggagcaggctcaaaatctcctctgctacatgaacatgcagacttttgcgcctttcctgatcagcaatgtgaagtttgtgaggaagcggactatccacattgtgggcgcgcgctccaactggtgtcctccgcaaaatcagctgtttttgcagaaaactctacagaactaccatctcgatgtcattcccggcggctcccacttggtcaacgttgaggctccggacctggtgatcgagaggattaatcaccacatccacgagtttgtccttacctccccgctgcagtcctcacacattccgcaattgacccttgaagaaagagcggtgatgtttgaccgggctttcgactcgttcaagaatgaagctttggttaaaacgactaaacaaaaactgtaaacacttgtgtacactattacatatattattcaataataattaactgacgcaatctatggcactggcgtggtttctttttcttttgttttccgtgcaagcgcgatgcaactatatcgtcgaggacgaatgtgtacccgtctttccgccagacaggtaacaagtacttcaattgacttagaagaaaaacattaaggaactttaacgtaggagcaacacaataccaggcacacgctcttcgaacactgaaccacacgcgtccgcatcaaactcttcctcccaaac

SEQ ID NO: 2 - protein, 387 aa, Saccharomyces cerevisiae
MEQNRFKKETKTCSASWPRAPQSTLCATDRLELTYDVYTSAERQRRSRTATRLNLVFLHGSGMSKVVWEYYLPRLVAADAEGNYAIDKVLLIDQVNHGDSAVRNRGRLGTNFNWIDGARDVLKIATCELGSIDSHPALNVVIGHSMGGFQALACDVLQPNLFHLLILIEPVVITRKAIGAGRPGLPPDSPQIPENLYNSLRLKTCDHFANESEYVKYMRNGSFFTNAHSQILQNIIDFERTKASGDDEDGGPVRTKMEQAQNLLCYMNMQTFAPFLISNVKFVRKRTIHIVGARSNWCPPQNQLFLQKTLQNYHLDVIPGGSHLVNVEAPDLVIERINHHIHEFVLTSPLQSSHIPQLTLEERAVMFDRAFDSFKNEALVKTTKQKL

SEQ ID NO: 3 - DNA, 25 bp, Primer
atggaacagaacaggttcaagaaag

SEQ ID NO: 4 - DNA, 27 bp, Primer
ttacagtttttgtttagtcgttttaac

SEQ ID NO: 5 - DNA, 1032 bp, Saccharomyces cerevisiae
  CDS (1)..(1032)
atgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacttgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatacccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccattga

SEQ ID NO: 6 - protein, 343 aa, Saccharomyces cerevisiae
MSNANNSAMNHITLPPISSFDNLIKAAERQYNGEASSASTHPTLPNMNISNGSGSAGASSSMLSYQLLPHSNDVSRSNSSSSFLPSVQQPTEGSASASETSSSASPSRSISPILKVAGPSSVGGAGVSTPHSTKINKPRKKKQCPICRNFYANLTTHKATHLTPEDRPHKCPICHRGFARNNDLLRHKKRHWKDEILSQSGVLSNHNDGKGGSVSPNDDDTHEKMTPMNSVTDYAQLKSLHQIKGTFKCPFNSTLIQLDMDMYPYKLKPLNFETSNCHQTGVFSRCDTFKNHLKALHFEYPPGTKKKDRNVVPGRCKHCGLKFENVDVWLNEHVGKQCGYKYH

SEQ ID NO: 7 - DNA, 960 bp, Eremothecium gossypii
  CDS (1)..(960)
atggcgcaggacaaccacatcacgctgccaccgatctcgtcgttcgacaatctgatccgggcagcgacggagcaggacttccacggcggcgcagcgccggccgcgcacgggcgcggggcgagcggcggcggcagcgcgagcgagtcgctgctgtcctaccagttatcgaacgtgagccggacggggtcgatgtcggggtcgctgtcgccggaccacaacaactacttcatgccgttccggcatgcgtcgctggatggcgggcggctgggggggagccagccgtcgtcggtggacgggtcgccgtcgctgaaggcgcagctgggtctgccgcacgggaccggggcgaaggtgtacaagacgaacaagccgcgcaagaagaaggagtgcccggtgtgccacaacttctatgcgaacctgtccacgcataagtcgacgcacctggacccggaggcgcggccgcacaagtgcgacatatgctcgcggggcttcgcgcggtcgaacgacctgcagcggcacaagaagcggcactggaaggacgagttctcgccgagccaggagctggccaaggcggacggggacgagcagcagcagcaaggcgcgggcagcaagctggagagcagcatccccaccgagcaactaaaaagtttacatatgatacagggtacgtacaagtgcccgttcaactcgacgctgatcaagctggacatggagatctaccccacgaaggggcggcggctggcgttcgagacctccaactgtcatatcaccggcgttttctcgcgctgcgacacgtacaagaaccatcttaaggcgctgcacttcgagtacccgccgggcacgaagaagcgcgagcgcgccaagatccacggccgctgcaagcactgtggcatgaagttcgacaacgtggacatgtggctgaacgagcatgtcggcaaggtgtgcgggtacttctaccactga

SEQ ID NO: 8 - protein, 319 aa, Eremothecium gossypii
MAQDNHITLPPISSFDNLIRAATEQDFHGGAAPAAHGRGASGGGSASESLLSYQLSNVSRTGSMSGSLSPDHNNYFMPFRHASLDGGRLGGSQPSSVDGSPSLKAQLGLPHGTGAKVYKTNKPRKKKECPVCHNFYANLSTHKSTHLDPEARPHKCDICSRGFARSNDLQRHKKRHWKDEFSPSQELAKADGDEQQQQGAGSKLESSIPTEQLKSLHMIQGTYKCPFNSTLIKLDMEIYPTKGRRLAFETSNCHITGVFSRCDTYKNHLKALHFEYPPGTKKRERAKIHGRCKHCGMKFDNVDMWLNEHVGKVCGYFYH

SEQ ID NO: 9 - DNA, 1473 bp, Saccharomyces cerevisiae
  CDS (1)..(1473)
atgctggtatcatcatcttttgcatcaagcattgactcagtaatgtcccatgagacgatgtctttacggagaaaccctccctttatagatactccagaaaaaatgccaaacccaacggcttctcccaatggcaccattcaccatttgatagatccatcactgccattgttgtccagtactacgtcgtcttcgcgctctaccctcagttctacactgaattctcctccacctcccccattaactacatcatactcttcttataactcctctgcatgccagtctatcacgagttcgcctacagacaatacagccttggcacataattccaaatgctatttccctcatagcctttctccaacaccgctgtcatccaacagctcaagccatgtcattttgccacccatatcctccttcaccaatttaattacagttgcagaaagagaatttaacggcagatcaaattccttgcatgccaattttacatcaccggtgccaagaacagtgctagatcatcacagacatgagctaacattttgcaaccctaacaacacaacgggtttcaaaaccatcaccccctcaccaccaactcaacaccagagtatattgccaaccgcggtagataacgtaccgagatcaaaatccgtgtccagcctacccgttagtggattcccacctttgatcgtcaaacaacaacagcaacagcaactcaacagtagtagtagtgcctctgcactaccgtctattcattccccattgactaatgaacatacaagcaggtattcatcgtctttaaaggattccgccaagataacgaagcaaagaaagaaaaaggaatgccccatctgccacaacttctacgccaacctatctacgcataaatccactcatttaactccggaggacagaccgcataagtgccctatctgtcaacgcggctttgccaggaacaatgatctgataaggcacaagaagcgccattggaaagatgaatttatgcaaatatacgcaagggagtccgacaacaatagtggtgctgacgatcaagatgacactgcccgcacctccgcaaacaacgacagcgacgactcaaacgataaactcgctgcctcatcctcttccgaagaaacaaaactactgaagaaaaaccaattgaaatcactatacaagattaaaggtgcattcaagtgtccttacaactctactctgatcaatttggatatggaggtgtatccacacaagtctagatcactctatttcgagccaataaactgtcatcaaacgggcgttttttcgcgctgtgatactttcaagaatcacctaaaggctttgcatttcgagtacccgcccaagaccaagaaagaagatagaggtgttgtgccggggaagtgcaagcattgtggactgcaatttccgaacgttgacgtctggctaaataagcacgtggggaaaggatgtggctactcatatcactaa

SEQ ID NO: 10 - protein, 490 aa, Saccharomyces cerevisiae
MLVSSSFASSIDSVMSHETMSLRRNPPFIDTPEKMPNPTASPNGTIHHLIDPSLPLLSSTTSSSRSTLSSTLNSPPPPPLTTSYSSYNSSACQSITSSPTDNTALAHNSKCYFPHSLSPTPLSSNSSSHVILPPISSFTNLITVAEREFNGRSNSLHANFTSPVPRTVLDHHRHELTFCNPNNTTGFKTITPSPPTQHQSILPTAVDNVPRSKSVSSLPVSGFPPLIVKQQQQQQLNSSSSASALPSIHSPLTNEHTSRYSSSLKDSAKITKQRKKKECPICHNFYANLSTHKSTHLTPEDRPHKCPICQRGFARNNDLIRHKKRHWKDEFMQIYARESDNNSGADDQDDTARTSANNDSDDSNDKLAASSSSEETKLLKKNQLKSLYKIKGAFKCPYNSTLINLDMEVYPHKSRSLYFEPINCHQTGVFSRCDTFKNHLKALHFEYPPKTKKEDRGVVPGKCKHCGLQFPNVDVWLNKHVGKGCGYSYH

SEQ ID NO: 11 - DNA, 26 bp, Primer
atgagtaatgcaaacaatagtgctat

SEQ ID NO: 12 - DNA, 25 bp, Primer
tcaatggtatttatagccgcattgt

SEQ ID NO: 13 - DNA, 1980 bp, Saccharomyces cerevisiae
  CDS (1)..(1980)
atggatagtacgaatttgaacaaacggcccttattacaatatagtctcagttcattgggctcgcaaataacaaaatggagctcatctagaccgacttcgccagttcgtaaggcgagaagcactgaaaatgactttctttccaagcaagatacgtctagtatcctcccaagtatcaacgacgacggcggtgaacagtggtacgaaaagttcaagcccaattgtttggagcaagtggccatacataaaagaaaacttaaagatgtacaagaagctttagatgccatgtttttacctaacgccaagcataggatcctactactgtctggccccagtggatgctctaaaagtacggtcataaaagaactctcaaaaatcttagttcctaaatacagacaaaacagcaacggaacgtcctttcgaagcaccccgaacgagcataaagtgaccgagtttagaggtgattgtatagtcaacgatcttcctcagatggaaagctttagtgagttcttaaaaggcgcacggtatcttgtgatgtccaacctgtcattaatacttatcgaggaccttcccaacgtcttccatatagataccagacgtcgatttcaacaacttatattacagtggctatatagttcggagcctctattacctccccttgttatatgtataactgaatgtgaaattccagagaacgataataattatcgcaaatttggtattgattatacatttagtgcagaaaccataatgaacaaagaaatattgatgcatccaaggttgaaaagaattaagtttaatccaattaacagcactttattaaaaaagcacttgaaatttatttgtgtacagaatatgaaaatgttgaaggagaaaaataaatggaataaaagacaggaagtcatagattatattgcgcaagagactggtgatattaggtcggccattacgacccttcaattttgggcgacatcaagtggaagtttgccgatttcaacccgagaatccaccatatcatactttcatgccattgggaaggtgatacatggttcccatagcacgaataacgataacgaaatgattaataacctcttcgaaaattcgaacaatttgttatcgaaagaggatttcaaattaggaatattagagaactataacacatttaataaaggcgaattcagcatttctgatgcatcatcaattgtggattgcctgagcgagtgtgataatatgaatggtctaccagaatccaatgagtatggtttacgagaagtgcgcaaaacctttcgtaacatcagtaaacaaggccataatcatggaacggtttattttccaagagaatggaaagtaagaaaattacaaaattcatttaaagttcaagctgaagattggttaaatgttagtctttataagtacaacgcggtacattctttcaggaatataactctagaatttggctactacgcacctctaattagaaagtgtcagagttataaaaaaaaatacattctctattatttgaagaatcttccgagtggctcctcggggcccaaacaaaccatggacaaatttagtgatataatgaaagttgagaacggaatcgacgttgtggatcggataggcgggcctatcgaagcactatctgtggaggatggactagcaccattgatggataatgatagcaataattgtgaccatttagaggatcaaaaaaaggaaagggacagaaggcttcgcatgttgattgaccaatatgaaagaaatgtgatgatggctaacgacgatcttgaagacgaagaaacttcttttaatgatgaccctattgtcgatagcgatagcgataacagcaataatattggcaatgaaacatttggtagaagcgacgaagacgagtctctatgtgaaattctgtcccagagacagccgcgtaaagcgccagttatcagtgagtccctttcagattcagatctggaaatactctaa

SEQ ID NO: 14 - protein, 659 aa, Saccharomyces cerevisiae
MDSTNLNKRPLLQYSLSSLGSQITKWSSSRPTSPVRKARSTENDFLSKQDTSSILPSINDDGGEQWYEKFKPNCLEQVAIHKRKLKDVQEALDAMFLPNAKHRILLLSGPSGCSKSTVIKELSKILVPKYRQNSNGTSFRSTPNEHKVTEFRGDCIVNDLPQMESFSEFLKGARYLVMSNLSLILIEDLPNVFHIDTRRRFQQLILQWLYSSEPLLPPLVICITECEIPENDNNYRKFGIDYTFSAETIMNKEILMHPRLKRIKFNPINSTLLKKHLKFICVQNMKMLKEKNKWNKRQEVIDYIAQETGDIRSAITTLQFWATSSGSLPISTRESTISYFHAIGKVIHGSHSTNNDNEMINNLFENSNNLLSKEDFKLGILENYNTFNKGEFSISDASSIVDCLSECDNMNGLPESNEYGLREVRKTFRNISKQGHNHGTVYFPREWKVRKLQNSFKVQAEDWLNVSLYKYNAVHSFRNITLEFGYYAPLIRKCQSYKKKYILYYLKNLPSGSSGPKQTMDKFSDIMKVENGIDVVDRIGGPIEALSVEDGLAPLMDNDSNNCDHLEDQKKERDRRLRMLIDQYERNVMMANDDLEDEETSFNDDPIVDSDSDNSNNIGNETFGRSDEDESLCEILSQRQPRKAPVISESLSDSDLEIL

SEQ ID NO: 15 - DNA, 26 bp, Primer
atggatagtacgaatttgaacaaacg

SEQ ID NO: 16 - DNA, 26 bp, Primer
ttagagtatttccagatctgaatctg

SEQ ID NO: 17 - DNA, 1581 bp, Saccharomyces cerevisiae
  CDS (1)..(1581)
atgacaatttctaatttgttaaagcagagagttaggtatgctccctatctgaaaaaagttaaggaagctcacgagcttattccattgttcaagaatggtcagtaccttgggtggtccggttttacaggagtgggtactcccaaggcagtgccggaggcactgatagatcacgtggagaagaacaatttacaagggaagttgagattcaacctttttgttggagcttctgctggtccagaggaaaaccgttgggctgaacacgacatgatcattaagagagcccctcatcaagtagggaaacccattgcaaaggcaattaaccagggtagaattgagttctttgataaacatctgtccatgttccctcaggatctgacatacgggttctacaccagggaaagaaaagacaacaaaatccttgattatactataatcgaggcaacggccattaaagaggacgggtctatcgtcccaggtccctctgtcggtggttctccagaattcattacagtcagtgataaagtgattattgaggttaacacggctacgccttcgttcgagggtattcacgatatagacatgcccgtgaacccacctttcaggaaaccatacccatatctgaaagtggacgacaagtgtggtgttgactccatcccggttgatcctgaaaaggttgttgcgattgtggagtccaccatgagggaccaggtcccaccaaatacgccctctgacgacatgtccagggctattgcaggtcatttggtcgagtttttcagaaacgaggtaaaacatggtaggctacctgaaaacctgctgcctttacaaagtggtataggtaacattgctaacgctgtcattgaagggcttgctggcgcccaattcaagcacttgactgtatggacggaagtgctgcaggactcgttcttggatcttttcgagaacggatctttggactacgccactgctacttccgtgagattgactgaaaagggtttcgacagagcctttgcaaactgggaaaatttcaaacacagattgtgtttgagatctcaagttgtctcgaacaatccggaaatgatccgtagattgggtgtcatcgccatgaataccccagtagaagttgacatttacgcgcacgccaattctacaaatgtgaatggttcccgtatgttgaacgggttgggtggatctgctgatttcttgagaaatgcaaagttgtccatcatgcatgccccctctgcaagaccaactaaagtagaccctaccggtatctctaccattgttcctatggcctctcatgtagatcaaactgagcatgacctggacatcttggtcactgaccaaggtttggcggatctaagaggtctatcgcctaaggaaagagcccgtgaaatcatcaacaagtgtgctcatcccgattatcaagctttgttgaccgattacttggacagagcagagcattacgctaaaaagcacaattgcttgcatgaaccacacatgctaaagaatgctttcaagttccacaccaacttagctgaaaagggtacaatgaaggtcgacagctgggaaccagttgactag

SEQ ID NO: 18 - protein, 526 aa, Saccharomyces cerevisiae
MTISNLLKQRVRYAPYLKKVKEAHELIPLFKNGQYLGWSGFTGVGTPKAVPEALIDHVEKNNLQGKLRFNLFVGASAGPEENRWAEHDMIIKRAPHQVGKPIAKAINQGRIEFFDKHLSMFPQDLTYGFYTRERKDNKILDYTIIEATAIKEDGSIVPGPSVGGSPEFITVSDKVIIEVNTATPSFEGIHDIDMPVNPPFRKPYPYLKVDDKCGVDSIPVDPEKVVAIVESTMRDQVPPNTPSDDMSRAIAGHLVEFFRNEVKHGRLPENLLPLQSGIGNIANAVIEGLAGAQFKHLTVWTEVLQDSFLDLFENGSLDYATATSVRLTEKGFDRAFANWENFKHRLCLRSQVVSNNPEMIRRLGVIAMNTPVEVDIYAHANSTNVNGSRMLNGLGGSADFLRNAKLSIMHAPSARPTKVDPTGISTIVPMASHVDQTEHDLDILVTDQGLADLRGLSPKERAREIINKCAHPDYQALLTDYLDRAEHYAKKHNCLHEPHMLKNAFKFHTNLAEKGTMKVDSWEPVD

SEQ ID NO: 19 - DNA, 1578 bp, Neurospora crassa
  CDS (1)..(1578)
atggcgtcgcccattgcctcggcggccctcagggcgcgtcaaggcccttccatgctcaagaagctctgcaaccccgaggacatgctccagcacttccccaatggcgcatacatcggctggtccggtttcaccgcgtcggctaccccaagaaggtcctactatctcgctgaccacgtcgagaagaacgcctccaggccagctcaagtacagcctcttcgtcggtgcctccgccggcgccgagaccgagaacgctgggctgctctcgacatgatcgcccatgatcgccgtcgcgctcctcaccaggtcggcaagaacattgccaagggcatcaacgagggccgcatcaacttcttcgacaagcacttgtccatgttccccgttgaccttgtctacggctactacaccaaggaccgccagaacaagaacctcgatgtcgtttgcgttgaagctaccgagatcaaggaggacggttccatcgtcctcggtgcctcggtcggtgccacccccgagctcatccagatggccgacaaggtcatcattgaggtcaacacggccatccccagcttcgacggtctccacgacatcaccttctccgacctccctcccaaccgcaagccctacctcatccagcagtgcagggaccgcatcggtactacttcggtccccgtcgaccccgagaaggttgtcggtatcatcgagtgcaccacccccgatcagaccctccccaactcccccgccgacgaaacggctacggccattgccggccacctgattgagttcttcgagcacgaggtcgcccacggccgtctgcccaagaaccttctccctctgcagtccggtatcggcaacatcgccaacgccgtcattggtggtctcgagacctccaacttcaagaacctcaacgtctggactgaggttatccaggataccttcctcgacctcttcgactccggcaagcttgactttgctaccgccacctcgatccgcttctcgcccaccggcttcgagcgcttctacaagaactgggacaactactatgacaagctcctcctccgctctcagtccgtctccaacgctcccgagatcatccgccgtctcggtgttatcggcatgaacacccccgtcgaagtcgacatctacgcccacgccaactccaccaacgtcatgggctcccgcatgctcaacggtctcggtggttccgccgatttcctccgcaactccaagtactccatcatgcacaccccctccacccgtccctccaagaccgacgcccacggtgtttcgtgcattgtccccatgtgcacccacgtcgaccagaccgagcacgatctcgacgtcatcgttaccgagaacggtctcgccgatgtccgcggcctcagcccccgcgagcgtgcccgcgtcatcattgacaagtgcgcccacgacgtctacaagcccatcctcaaggcctactttgagaaggccgagttcgagtgccttcgcaagggtatgggccacgagccccaccttctcttcaactctttcgacatgcacaaggctcttgtcgaggagggctccatggccaaggtcaagttctaa

SEQ ID NO: 20 - protein, 525 aa, Neurospora crassa
MASPIASAALRARQGPSMLKKLCNPEDMLQHFPNGAYIGWSGFTASATPRRSYYLADHVEKNASRPAQVQPLRRCLRRRRDRERWAALDMIAHDRRRAPHQVGKNIAKGINEGRINFFDKHLSMFPVDLVYGYYTKDRQNKNLDVVCVEATEIKEDGSIVLGASVGATPELIQMADKVIIEVNTAIPSFDGLHDITFSDLPPNRKPYLIQQCRDRIGTTSVPVDPEKVVGIIECTTPDQTLPNSPADETATAIAGHLIEFFEHEVAHGRLPKNLLPLQSGIGNIANAVIGGLETSNFKNLNVWTEVIQDTFLDLFDSGKLDFATATSIRFSPTGFERFYKNWDNYYDKLLLRSQSVSNAPEIIRRLGVIGMNTPVEVDIYAHANSTNVMGSRMLNGLGGSADFLRNSKYSIMHTPSTRPSKTDAHGVSCIVPMCTHVDQTEHDLDVIVTENGLADVRGLSPRERARVIIDKCAHDVYKPILKAYFEKAEFECLRKGMGHEPHLLFNSFDMHKALVEEGSMAKVKF

SEQ ID NO: 21 - DNA, 1491 bp, Brucella melitensis
  CDS (1)..(1491)
atgttggaagcacgtatccgtaacagttcactgcgaaacaaggttatcactgcggagcaagcggcaagctttatcaaggatggcatgattgttggcatgagcggctttacgcgcgcgggcgatgccaaggccgttccggtcgccatggccgcgcgggcggcaaccgatccattccagatcaccctgattacaggggcctccctcggacatgacgtcgataaactgttgaccgaagcgcatattctttctcgccgtatgccgtttcaggccgaccgcacattgcgcagcgcgatcaaccgcggcgaagtcatgtttatcgaccagcatctttccgaaacagtcgagcaacttcgttccaaccagatcggccccatcgactgtgccgtggtagaggcattggcgattaccgaaagcggcggaatcatcccgacgacttcggtcggcaattcggccagcctcgccattcttgccgaaaaggttatcgtcgaggtcaatctgaaccagcccatggcgctggaaggcctgcacgatatttatataccgacgaagcgcccttcccgcgatcctatcccgatcatggcttgcgatagccggatcggactgccctatattcccatcgcgccggaaaaaatcgccggtatcgtcatcacgcaggaaaatgacagtgcgtcacctgtcgagcccgcagatcacgaaacggttgcgattgccgggcatctgatcgaattcttcaagggggaagtcgtaaagggtcgtctggatctggcgcttaatccattgcaggcgggcatcggcaccattgccaatgcggttttgaccggctttgcagatagtcctttccacaatctgcgcatgtatagcgaggtattgcaggatagcacgttcgatctgttcgatgcgggcaagctggattttgcctccggctcatcgatcactctcagccccgcttgcggcgagcgcgttttcaataatatagaccgctatcgtgacaggcttgtcctgcgcccgcaggaaatcagcaaccatccggaagtcatccgccgtcttggtattatcggcatcaataccgcactcgaattcgatatctacggcaacgtcaactcaacccatgttgatggaaccaatatgatgaacggcattggcggttccggcgattttgcgcgcaacgcctatatttcgatcttcgtcagcaagtcggaagccaagaatggcgcgatctcctcggtcgtgcccatggtaacacatgtggaccacacggaacatgacgtggatatcctcgtgacggaacagggacttgccgatttgcgcgggcttgcaccacgcgagcgagcgcccgttatcattgaaaattgcgcacatcccgattaccgggaccagctcatggattattacgagcgagcctgcaaacgcggcggccacacgcctcatcttctggaagaggcattcagttggcacctgcgccgtcaggaaaatggcagtatgcgcaaataa

SEQ ID NO: 22 - protein, 496 aa, Brucella melitensis
MLEARIRNSSLRNKVITAEQAASFIKDGMIVGMSGFTRAGDAKAVPVAMAARAATDPFQITLITGASLGHDVDKLLTEAHILSRRMPFQADRTLRSAINRGEVMFIDQHLSETVEQLRSNQIGPIDCAVVEALAITESGGIIPTTSVGNSASLAILAEKVIVEVNLNQPMALEGLHDIYIPTKRPSRDPIPIMACDSRIGLPYIPIAPEKIAGIVITQENDSASPVEPADHETVAIAGHLIEFFKGEVVKGRLDLALNPLQAGIGTIANAVLTGFADSPFHNLRMYSEVLQDSTFDLFDAGKLDFASGSSITLSPACGERVFNNIDRYRDRLVLRPQEISNHPEVIRRLGIIGINTALEFDIYGNVNSTHVDGTNMMNGIGGSGDFARNAYISIFVSKSEAKNGAISSVVPMVTHVDHTEHDVDILVTEQGLADLRGLAPRERAPVIIENCAHPDYRDQLMDYYERACKRGGHTPHLLEEAFSWHLRRQENGSMRK

SEQ ID NO: 23 - DNA, 1497 bp, Agrobacterium tumefaciens
  CDS (1)..(1497)
atgcttgaaaagcgtatccgcaacgcgtccctcttgaacaggatcgtcagcgccgaagaggccgccagtctcattcaggatggcatgacggtgggcatgagcggttttacgcgcgccggtgaagccaaggcagtgccgctggcgctggccgagcgcgccaagaccaaccccatgaaaatcaccctgatgaccggcgcctccctcggcaacgatctcgacaagaccatggtcgaggccggcatgctggcgcgccgcatgccgttccagtccgatccggctttgcgcaaggcgatcaatgacggcagggtgatgttcatcgatcagcatctttccgaaacggtcgagcaattgcgcggcggtcagatccatggcgttgatatcgccattgtcgaggcggtggcaatcacggcggaaggcggcatcgtacccaccacctcggttggtaattccgcaagtttcgccattctggccgataaggtcatcgtcgagatcaacctgtcgcagcccgaggtgctggaagggctgcatgatatcttcattcccgccaagcgcccgacccgtatgcccatccccgtcgtggcgacggatagccgtgtcggcctgcctttcattccggtgccgccggaaaagatcgctgccattgtgctgagcgacaagagcgacagtttttcgacagtgctgccgccggatgacgagacgaaggcgattgccggccatctcaccgaattcctgctgaatgaggtccgtcatggccgcatgacgcatgaactccagccgttgcaggcaggcatcggcaccatcgccaatgccgtgatgcacgggttcatcgatacgccgtttcacgatctcaaaatgtattcggaggtcctgcaggattcgaccttcgaactgttcgatgcgggcaagctgaccttcgcctccggttcgtcaatcacgctctcctccgccatgaacgagcaggtcatgccacgattgtccgagtataagagcagactgatccttcgcccgcaggaggtcagcaaccatccggaagtcatccgccgcctcggcatcatcggcatcaacacagctctggaattcgatatttacggaaatgtcaattccactcatgtcggtggcactcacatgatgaacggcatcggcggttcgggtgattttgcccgcaacgcttacatgtccatcttcgtgacgaaatccatcgccaagggcggtgccatttccagcgtcgtgcccatggtcagccatgtcgaccataccgaacacgatgtcgatattctcgtcacagaaacgggcctagccgatctgcgcggtctggccccgcgcgagcgcgcagcggtcatcatcgcaaactgcgtgcatcccagctatcgcgatgcgctgacggattattaccagcgagcagcggcgcggggcgggcacacgccgcatctcatcgaagaagcgctgtcatggcacaatgcgcttcgggaaagaggcaccatgctgccgcagcgatag

SEQ ID NO: 24 - protein, 498 aa, Agrobacterium tumefaciens
MLEKRIRNASLLNRIVSAEEAASLIQDGMTVGMSGFTRAGEAKAVPLALAERAKTNPMKITLMTGASLGNDLDKTMVEAGMLARRMPFQSDPALRKAINDGRVMFIDQHLSETVEQLRGGQIHGVDIAIVEAVAITAEGGIVPTTSVGNSASFAILADKVIVEINLSQPEVLEGLHDIFIPAKRPTRMPIPVVATDSRVGLPFIPVPPEKIAAIVLSDKSDSFSTVLPPDDETKAIAGHLTEFLLNEVRHGRMTHELQPLQAGIGTIANAVMHGFIDTPFHDLKMYSEVLQDSTFELFDAGKLTFASGSSITLSSAMNEQVMPRLSEYKSRLILRPQEVSNHPEVIRRLGIIGINTALEFDIYGNVNSTHVGGTHMMNGIGGSGDFARNAYMSIFVTKSIAKGGAISSVVPMVSHVDHTEHDVDILVTETGLADLRGLAPRERAAVIIANCVHPSYRDALTDYYQRAAARGGHTPHLIEEALSWHNALRERGTMLPQR

SEQ ID NO: 25 - DNA, 1545 bp, Caulobacter crescentus
  CDS (1)..(1545)
atgcgggtgaagcaagcgcgtggggcgagcatgagcggatcacggatcgggctggacgcgctgaaggccaaggtgatgtcgcccgaggacgcggcggcgctgatcggtccaggcgagaccgtcggcatgagcggcttcaccggatcgggctatcccaaggccgttcccacagccctggcgcgccgcatcgaggccgagcacgccgctgggcgtcccttcaagctgcgcgtctggaccggcgcctcgacgggacccgagctggacggggccctggccaaggccaacggcatcgagttccgcctaccctacaattccgaccctatcgcccgggaaatgatcaatcgcggcgagatggactatttcgacatgcacctgtcgcaggtggcgccgatggcctggcaaggctttctgggtccgctcgacaccgccctgatcgaggtcaccgggatccggtcggacggttcgctgatcccgtcctcgtccgtgggcaacaacaagacctggatcgaacgggcctcgaaagtgatccttgaggtgaaccgttggcagaaccccgccttggaggggatgcacgatatctattacggcacggccttgccgccggaccggcgccctattccgttgacgcgaccggaccagcggatcggcgagccatatttccggtgcgacccggcgaaggtcgtggcggtggtcgaaaccgacacccccgatcgcaatctgccgttcgatgcgccgggcgaggatcaccgcgccatcgccggccaccttctggagtttttccgccacgaggtggcgcggggtcgcctgccggccaacctgctgccgctgcagtcgggcgtcggcaacatcgccaatgcggtgatgttcggcctggtcgatgggccgttcgagggtacgaccgcctttaccgaggtcctgcaggatgggatgctggcgctgctggagtcgggcaggctgctcagcgcctcggccacggccttctctctcagccccgaggccgcccatacgctgaacgccgacctcgacaaactccgcgaccgcctggtcctgcgaccgcaggagatcagcaatcaccccgagctgatccgacgcctgggctgcctcgccatgaacggcatgatcgaggccgacatccacggggcggtgaactcgacccacctgatgggctcgcgcatccagaacggcatcggcggcagcggcgacttcgcccgcaacgcctatgtctcgattttcatggccccctcgacggccaagggcggcaagatctcgaccattgtgcccaagaccccgcacgtcgatcacatcaaccaggacgtccaggtcctggtcaccgagcagggcctggccgatctgcgggccctgtcgccgcggcagcgggccgaggtgatcatcgagaactgcgcccatccagactatcgaccggccttgaaggactatctgacccgcgcccgccgcgactcctacggccagcagtcgccgaccctgctgatggaagccttcgcctggcaccagcggtttatcgagaccggcgatatgcgcgggtga

SEQ ID NO: 26 - protein, 514 aa, Caulobacter crescentus
MRVKQARGASMSGSRIGLDALKAKVMSPEDAAALIGPGETVGMSGFTGSGYPKAVPTALARRIEAEHAAGRPFKLRVWTGASTGPELDGALAKANGIEFRLPYNSDPIAREMINRGEMDYFDMHLSQVAPMAWQGFLGPLDTALIEVTGIRSDGSLIPSSSVGNNKTWIERASKVILEVNRWQNPALEGMHDIYYGTALPPDRRPIPLTRPDQRIGEPYFRCDPAKVVAVVETDTPDRNLPFDAPGEDHRAIAGHLLEFFRHEVARGRLPANLLPLQSGVGNIANAVMFGLVDGPFEGTTAFTEVLQDGMLALLESGRLLSASATAFSLSPEAAHTLNADLDKLRDRLVLRPQEISNHPELIRRLGCLAMNGMIEADIHGAVNSTHLMGSRIQNGIGGSGDFARNAYVSIFMAPSTAKGGKISTIVPKTPHVDHINQDVQVLVTEQGLADLRALSPRQRAEVIIENCAHPDYRPALKDYLTRARRDSYGQQSPTLLMEAFAWHQRFIETGDMRG

SEQ ID NO: 27 - DNA, 1479 bp, Escherichia coli
  CDS (1)..(1479)
atggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 28 - protein, 492 aa, Escherichia coli
METQWTRMTANEAAEIIQHNDMVAFSGFTPAGSPKALPTAIARRANEQHEAKKPYQIRLLTGASISAAADDVLSDADAVSWRAPYQTSSGLRKKINQGAVSFVDLHLSEVAQMVNYGFFGDIDVAVIEASALAPDGRVWLTSGIGNAPTWLLRAKKVIIELNHYHDPRVAELADIVIPGAPPRRNSVSIFHAMDRVGTRYVQIDPKKIVAVVETNLPDAGNMLDKQNPMCQQIADNVVTFLLQEMAHGRIPPEFLPLQSGVGNINNAVMARLGENPVIPPFMMYSEVLQESVVHLLETGKISGASASSLTISADSLRKIYDNMDYFASRIVLRPQEISNNPEIIRRLGVIALNVGLEFDIYGHANSTHVAGVDLMNGIGGSGDFERNAYLSIFMAPSIAKEGKISTVVPMCSHVDHSEHSVKVIITEQGIADLRGLSPLQRARTIIDNCAHPMYRDYLHRYLENAPGGHIHHDLSHVFDLHRNLIATGSMLG

SEQ ID NO: 29 - DNA, 1476 bp, Halobacterium sp. NRC-1
  CDS (1)..(1476)
atgacagcaccgcggacggccggcgtggcggggcgcgtgaacggcgactgtccggtcaaagacgccaccaccgtggcggccggcatcgccgacgacgcgacgctcgcggtgtctgggttcgggagcgtcggcgacccgaaggcggtgccacgggcgctggccgcggccgcgcgcgacggccgcgacctcgcgctcaccgtcgtctccggggggagcgtcggcgacccactggacaccgatctcgtggcggcgggcggcgtcgcgcggcggtacccgtatcaggcgacgacggccgcgcggacggccgcgaacgagcgggagttggcgttcgcggatcgcgggatcgccgggctgagcgacgaggtgcggttcgggcggctggtggaccccgacgtggcggtcgtggaggcggtggcggtcgggccggggtggctgatcccctcgacgtccgtggggcagacgccggcgtacgtgcgggcggccgacgaggtggtggtggaggtcaacgacgcccagccgatggggctgtcggcgttccacgacgtggtggtgcgtgacccgccgcccgaccgggggccgctggcggtgtccgcgccgggcgagcgggtgggcgagtcggccgtgcgattcgaccccgagaagctgcgcgcggtcgtgcgcacggaccgccgtgatgatccctacgagttccgtgacccgaccgcgactgaccgccgcatcgccgacaacgtcttgaccgtgttggagcgcgccgtcgaccgtgatccggtgatcggggcggcaccgacgctccagttcggcgtcggcagcctcgggaacgcgttgatgggcgcgctgtcggggtcgtcgctcgccgacggtgagctgcggtattacggcgaggtgatccaggacggcctgttggacctgcttgcggacggcgacctggcggtggcgagcgcgacctcgctggcgctctcagtggacggacaggatcgcgtgttcgacgcgcccgagcggtacgccgaggacgtggtgctccgcccgtcgaacgtctcgaacgcgccgtcgctgatcgaccggttcggggtggtcgcggtcaacagcgcggtcggcgtggatctctacggacacgtcaactccacacacgtctcaggggcgcggctcatcaacggcatcggcggcagcgtcgatttcaatcggaacgcccacctcactgtggtggcgctgcccgcgaccgcggccggcggcgacgtgtcgacggtcgtgccgctggcgagccacgtcgaccacaccgaacacgacaccgacgtggtggtgaccgagcacggcgtcgcggacctgcgcgggaagccacccgtcgcgcgcgccgaggcgatcatcgagtgcgccgcccccgcgttcaggccggatctgcgggcgtacctggatcgcgcccgggagtcatcggggcacctcccacacgacttgtcgacggcgttcgactggcagtcgtag

SEQ ID NO: 30 - protein, 491 aa, Halobacterium sp. NRC-1
MTAPRTAGVAGRVNGDCPVKDATTVAAGIADDATLAVSGFGSVGDPKAVPRALAAAARDGRDLALTVVSGGSVGDPLDTDLVAAGGVARRYPYQATTAARTAANERELAFADRGIAGLSDEVRFGRLVDPDVAVVEAVAVGPGWLIPSTSVGQTPAYVRAADEVVVEVNDAQPMGLSAFHDVVVRDPPPDRGPLAVSAPGERVGESAVRFDPEKLRAVVRTDRRDDPYEFRDPTATDRRIADNVLTVLERAVDRDPVIGAAPTLQFGVGSLGNALMGALSGSSLADGELRYYGEVIQDGLLDLLADGDLAVASATSLALSVDGQDRVFDAPERYAEDVVLRPSNVSNAPSLIDRFGVVAVNSAVGVDLYGHVNSTHVSGARLINGIGGSVDFNRNAHLTVVALPATAAGGDVSTVVPLASHVDHTEHDTDVVVTEHGVADLRGKPPVARAEAIIECAAPAFRPDLRAYLDRARESSGHLPHDLSTAFDWQS

SEQ ID NO: 31 - DNA, 1672 bp, Acetobacter aceti
  CDS (61)..(1536)
aaaggcaggaagccctctcatgacagagcgcattcggaacgtcgcgctgcgcagtaaagtatgtccggcagaaaccgcatccgagttgatcaagcacggagacgtggtggggaccagcggttttaccggggcaggttaccccaaggaagtacccaaggcgctggcccagcggatggaactgcgcatgatcggggcgaaaaataccagatcagcctgattacgggcgcatccacgggccctcagctggatggtgagctggccaaggccaacggggtgtatttccgctcgccattcaatacggatgccaccatgcgcaaccgtattaatgcgggtgaaacggaatattttgataaccatctggggcaggtggctggccgtgccgtgcagggcaattacggcaagttcaatattgcgctggtggaagccacagccattacggaagatggcggcattgtgcccacatcttctgtcggcaattcccagacattcctcaatctggccgaaaaggtcattatcgaggtaaatgaatggcagaatccgatgctggaaggcatccatgatatctgggatggcaacgtaagtggcgtgcctacgcgtgatattgtgccgattgtacgggcagatcagcgcgtgggtggcccggttttacgggtgaacccggacaagattgctgccattgtacgcacgaatgaccgggacagaaatgccccgtttgccgcgccggatgaaacagcaaaagctattgcgggctatttgcttgatttctttgggcatgaagtcaaacagaaccgtttgccgccctcacttctgccgctccagtctggtgtgggcaatgtggccaacgccgtgctggaagggctgaaggaaggcccatttgaaaatctggtgggctatagtgaggtgattcaggatggcatgttggccatgctggattctggccgtatgcgtattgcctctgcctcgtctttctcgctgagcccggaagctgcggaagaaatcaataaccggatggatttcttccgcagcaagatcattctgcgccagcaggatgtcagcaacagccccggcattatccgccgtttaggctgcattgccatgaacggcatgattgaggcggatatttacggaaacgtgaattctacccgcgtgatgggttccaaaatgatgaatggtattgggggatcgggtgattttgcccggagttcctacctgtccatcttcctgtctccctccacagccaaaggtggcaagatttcagccattgtgccgatggctgcgcatgtggaccacatcatgcaggatgcgcagatttttgtaaccgagcaggggctggcggatctgcgtgggctttcaccggtgcaacgtgcgcgtgaaattatttccaaatgtgcgcatccggattaccggccgatgttgcaggattattttgatcgtgcgcttaaaaattcctttggtaagcacacaccgcatctgctgacggaagctctgtcttggcatcagcggtttattgatacgggcaccatgctcccatcataaaaaaggggtggatttccacctctttttttcggcttcttcccatgtttcttatgagggtgggaggaagccttttttacaatcagcttttattggtggttgtatcggcgagttgcgtgggttgttgggtaatcatgat

SEQ ID NO: 32 - protein, 491 aa, Acetobacter aceti
MSGRNRIRVDQARRRGGDQRFYRGRLPQGSTQGAGPADGTAHDRGEKYQISLITGASTGPQLDGELAKANGVYFRSPFNTDATMRNRINAGETEYFDNHLGQVAGRAVQGNYGKFNIALVEATAITEDGGIVPTSSVGNSQTFLNLAEKVIIEVNEWQNPMLEGIHDIWDGNVSGVPTRDIVPIVRADQRVGGPVLRVNPDKIAAIVRTNDRDRNAPFAAPDETAKAIAGYLLDFFGHEVKQNRLPPSLLPLQSGVGNVANAVLEGLKEGPFENLVGYSEVIQDGMLAMLDSGRMRIASASSFSLSPEAAEEINNRMDFFRSKIILRQQDVSNSPGIIRRLGCIAMNGMIEADIYGNVNSTRVMGSKMMNGIGGSGDFARSSYLSIFLSPSTAKGGKISAIVPMAAHVDHIMQDAQIFVTEQGLADLRGLSPVQRAREIISKCAHPDYRPMLQDYFDRALKNSFGKHTPHLLTEALSWHQRFIDTGTMLPS

SEQ ID NO: 33 - DNA, 1566 bp, Schizosaccharomyces pombe
  CDS (1)..(1566)
atgccgtctcttctgagttcacgcattcgcaatgccgaatttgccaaaaaaattgttacggatcctgccaagttggttccgtactttaaaaatggggactatgttggttggtctggttttactggtgtcggttatcctaaaatgattccaaacgcgttagcaagacatgtcgaagagaacaatttgcaaggaaaattgcgttttaaattgttcgttggtgcctcgggaggtgctgatacggaatgcaagtgggctgaattgaatatgattgagcgccggtgtcctcatcaagtaggaaagccaatttctaaaggaattaactctggcagaattcagtttttcgacaagcatttatccatgtttccccaagatttactttatggctactatactcgtaatcgtgaaagtaatacaattgacacagccattattgaggccacagccattaccgaggacggcggaattgttcccggcgcatcagttggtgcgagtccggaacttatgcaacttgcggaaaagattatcatcgaggtgaacactgccattccttcttttgaaggacttcatgacattgtcgaaattcccaaccccccacatcgtactccaataaacatcaatcgagttgacgatcgtattggaaagccatacatcaaagtggatcccaaaaaggttattggaatagtggaggctgattatggagacatcacatgcgctaactctccgcaagatgagacttcgcaggctattgcaggccatttagttgactttttccatcatgaagtatctgtagggcgtcttcccaaaaatcttcatcctttgcaatccggtattggaaacattgccaacgctattatcggtggtcttgcccattctccctttaaagatctcgaagtgtggacagaagtcttacaagatactttcttgcctctctttgactctgaaaagttacgttttgctactgctacctcaacccgtttttctcctcagggatttgaaaaattctactcaaactatgattactacaaggaaagaattttgttacgccctcaagtaatttccaatcaccctgaaattatccgccgtcttggttgcatcgctatgaatactcctgtggaagccgatatttacgctcatgccaatagtacaaatgttttgggaagcagaatgttgaacggtttaggtggttctgctgatttcttgcgtaatgcgaaattaagtattatgcatacaccatcggttcgtccttcgaagaaggatcctactggtatcacttgtattgttcctatggctacccatgttgaccaaaccgaacatgatttggatattttggttacagagcaaggattggctgatttacgaggcttgtctcctaccgaacgtgctcgtgaggttattgacaagtgtgctcatcctgactataagcctctgctcagagagtatttcgatattgccgaaaactactgtttagctagaggagctggtcatgaaccccatattcttgccaatgctttcaagatgcagctcaaccttttagaaaaaggaacgatgaagatcgatcattggtaa

SEQ ID NO: 34 - protein, 521 aa, Schizosaccharomyces pombe
MPSLLSSRIRNAEFAKKIVTDPAKLVPYFKNGDYVGWSGFTGVGYPKMIPNALARHVEENNLQGKLRFKLFVGASGGADTECKWAELNMIERRCPHQVGKPISKGINSGRIQFFDKHLSMFPQDLLYGYYTRNRESNTIDTAIIEATAITEDGGIVPGASVGASPELMQLAEKIIIEVNTAIPSFEGLHDIVEIPNPPHRTPININRVDDRIGKPYIKVDPKKVIGIVEADYGDITCANSPQDETSQAIAGHLVDFFHHEVSVGRLPKNLHPLQSGIGNIANAIIGGLAHSPFKDLEVWTEVLQDTFLPLFDSEKLRFATATSTRFSPQGFEKFYSNYDYYKERILLRPQVISNHPEIIRRLGCIAMNTPVEADIYAHANSTNVLGSRMLNGLGGSADFLRNAKLSIMHTPSVRPSKKDPTGITCIVPMATHVDQTEHDLDILVTEQGLADLRGLSPTERAREVIDKCAHPDYKPLLREYFDIAENYCLARGAGHEPHILANAFKMQLNLLEKGTMKIDHW

SEQ ID NO: 35 - DNA, 1857 bp, Clostridium thermosaccharolyticum, Clostridium tartarivorum
  CDS (1)..(1497)
atgaattttgaagagcggattagatgcaatataattaaaaataaagtaatgtcggcagaagaagcagctttattgataaaagatggtatgacaataggtacaagtggttttgtaacaggtggtcctaaagctgtaccattggcaattgctgaaagatataaaaatgaaaagataaagttaaatctttatacaggtgctatagtaggtgatgaattagatggtgctttcgcacgggaaggtttagtcaataaaagaattccgtatcaaacaaataaagacatgagaaatgctataaataatggttcagttaaatttattgatatgcatctaagtcatatgccacagcaaataagatatggttttttaggaaaaattgatatcgccattattgaagcaactgctataacagaagatggaggcattattcctaccatgtctgtcggtaattcaccgacatttgtaaatatggccgataaagtcatagtagaaataaatacatcacagcctattgaacttgaaggaatgcacgatatatacgagccaaaagatccaccatatagagagccgataccaatatcgaaagttagtgataggataggtgttccgtatattccatgcaatccagataaaatagctgcagttgtattttcagatatgaaagatacaacgttacaacttacaagtataaatgaaacatcaaaaaagatttcagattatcttatagattttcttcaaactgaaataaaacacggaagacttcctaaaacatttcttccattgcagtcaggtattggaaatgtagccaatgctgtactaggcggttttattgaattaaaatacaacaacttgaatttatattctgaagtaatacaagatgctgttctcgatttgatagatgctgataaggtagaaaaagtatcaggaactgcattgaccctttcagaagaaggacttaagagattttataccaatataaataaatataaagacaaaataatattgcgtccacaagagctcagtaataatcctgaaataatcagaagattaggagttatatcaattaacacagcaatagaagtggatatatacggtaatgtaaattctacacatatattaggcacaaaaatgatgaacggcataggtggttcagcagattttactagaaatgcttatatatcaatttttgctacgccatcaacagcaaaagatgataatatttcatgcatagtgccgatggtatcacatgtagatcatacagagcatgatgtcatggtggtagtaactgagcaaggactggctgatttaagaggtttaagtccgaaggaaagagctatagcaattataaaaaattgtgcacatcccgactataaagacgttttaatggagtattatgaaagagcgattaaaaaacatggcgctgtgcaaacaccgaatttactcgatgaagcatttttatggcatacaagatattcaaatacaggtagtatgaaaatatgataaatttatattattacctgaaaattatagttgttagtcttcatttctaaattaaagtgaattatatttttataaaagattttaaaaaacttttatcgtaaaagcataaaagagagagtcaaccagtttaatacggatgaagttgatttccatgtaagtcgtgacaaaaaattgaataatgataaaaaaatataaagaagcttagaataagaaaattactgaactatctacgatagatatttgatttctttataaatattttttaacaaaaggcttgaaagaagtctcccatcctccataggtgggagatgaatttctatattttttgtagggaaggttcctcccgaagttacgcctatg

SEQ ID NO: 36 - protein, 498 aa, Clostridium thermosaccharolyticum, Clostridium tartarivorum
MNFEERIRCNIIKNKVMSAEEAALLIKDGMTIGTSGFVTGGPKAVPLAIAERYKNEKIKLNLYTGAIVGDELDGAFAREGLVNKRIPYQTNKDMRNAINNGSVKFIDMHLSHMPQQIRYGFLGKIDIAIIEATAITEDGGIIPTMSVGNSPTFVNMADKVIVEINTSQPIELEGMHDIYEPKDPPYREPIPISKVSDRIGVPYIPCNPDKIAAVVFSDMKDTTLQLTSINETSKKISDYLIDFLQTEIKHGRLPKTFLPLQSGIGNVANAVLGGFIELKYNNLNLYSEVIQDAVLDLIDADKVEKVSGTALTLSEEGLKRFYTNINKYKDKIILRPQELSNNPEIIRRLGVISINTAIEVDIYGNVNSTHILGTKMMNGIGGSADFTRNAYISIFATPSTAKDDNISCIVPMVSHVDHTEHDVMVVVTEQGLADLRGLSPKERAIAIIKNCAHPDYKDVLMEYYERAIKKHGAVQTPNLLDEAFLWHTRYSNTGSMKI

SEQ ID NO: 37 - DNA, 1494 bp, Pseudomonas aeruginosa
  CDS (1)..(1494)
atgtaccgtgatcgcgtgcgcctgccctccctgctcgacaaggtgatgagtgcggccgaagccgccgacctgatccaggacggcatgaccgtcggcatgagcggtttcacccgcgccggcgaggccaaggccgtaccccaggcgctggccatgcgcgccaaggaacgtccgctgcgtatcagcctgatgaccggcgccagcctcggcaacgacctcgacaagcagctcaccgaggccggcgtgctcgcccggcgcatgccgttccaggtcgacagcaccctgcgcaaggcgatcaacgccggcgaagtgatgttcatcgaccagcacctctcggaaaccgtcgagcagttgcgcaaccaccagctgaagctgccggacatcgccgtcatcgaagccgccgcgatcaccgagcagggccacatcgtgccgaccacctcggtgggcaactcggcgagcttcgcgatcttcgccaagcaggtcatcgtcgagatcaacctggcccacagcaccaacctggaaggcctgcacgacatctatatcccgacctaccggccgacccgcacgccgatcccgctgacccgcgtcgacgaccgcatcggcagcacggcgatcccgatcccgccggagaagatcgtcgccatcgtcatcaacgaccagccggactcgccatccaccgtgctgccgccggacggcgagacccaggccatcgccaaccacctgatcgatttcttcaagcgcgaggtcgacgccgggcgcatgagcaacagcctcggcccgctgcaggccggtttcggcagcatccccaacgcggtgatgtgcggcctgatcgagtcgccgttcgagaacctgaccatgtactccgaagtgctgcaggactcgaccttcgacctgatcgacgccggcaagctgcgcttcgcctcgggcagctcgatcaccctgtcgccgcggcgcaacgccgacgtgttcggtaacctggagcgctacaaggacaagctggtgctgcgcccgcaggaaatctccaaccaccccgaggtggtccgtcgcctgggcatcatcggcatcaatacggcgctggagttcgacatctacggcaacgtcaactcgacccacgtcggcggcaccaagatgatgaacggcatcggcggctccggcgacttcgcccgcaacgcgcacctggcgatcttcgtcaccaagtcgatcgccaagggcggcaacatttccagcgtggtgccgatggtcagccacgtcgaccacaccgagcacgacgtcgacatcctcgtcaccgagcagggcctcgccgacctgcgcggcctggcgcctcgcgaacgggcccgggtgatcatcgagaactgtgtccacccgtcctaccaggcaccgctgctggactacttcgaggcggcttgcgcgaaaggcggccacacgccgcatctgttgcgcgaggcgctggcctggcacctgaacctggaagaacgcggacacatgctggccggctga

SEQ ID NO: 38 - protein, 497 aa, Pseudomonas aeruginosa
MYRDRVRLPSLLDKVMSAAEAADLIQDGMTVGMSGFTRAGEAKAVPQALAMRAKERPLRISLMTGASLGNDLDKQLTEAGVLARRMPFQVDSTLRKAINAGEVMFIDQHLSETVEQLRNHQLKLPDIAVIEAAAITEQGHIVPTTSVGNSASFAIFAKQVIVEINLAHSTNLEGLHDIYIPTYRPTRTPIPLTRVDDRIGSTAIPIPPEKIVAIVINDQPDSPSTVLPPDGETQAIANHLIDFFKREVDAGRMSNSLGPLQAGFGSIPNAVMCGLIESPFENLTMYSEVLQDSTFDLIDAGKLRFASGSSITLSPRRNADVFGNLERYKDKLVLRPQEISNHPEVVRRLGIIGINTALEFDIYGNVNSTHVGGTKMMNGIGGSGDFARNAHLAIFVTKSIAKGGNISSVVPMVSHVDHTEHDVDILVTEQGLADLRGLAPRERARVIIENCVHPSYQAPLLDYFEAACAKGGHTPHLLREALAWHLNLEERGHMLAG

SEQ ID NO: 39 - DNA, 1912 bp, Porphyromonas gingivalis
  CDS (136)..(1431)
tttgagtcttccaaaaagatgttgtagaaagatttaccatagcgcgaaaaagttattttagtttccacttgagtggatttacctttcatactttattcatcctttttaataaaaatcatctgtaagaatattactatgcaatggcaagaactttaccgtcagcgcgtttgctctgcagacgaagctgtcgtggactctcttaaaccgggaacgaaagttgtattcggtcatgctgctgctgcgcctgtccgtttctctcaggctatgtaccgccagcgtgaaaagttggagaatatcacagttttccacatgttgtatttcggcgacgcgccgcaccttgctcccgaaatgcgttcgcatgtacacccgactctcaacttccttgagggcaactcccgtccggcaagccgtgaccgtcgtgtcgatttcattccctgccacttccacgaggtaccggaactgtttcgtcagggattctttccattggatgtagccgtagtgcaggtatctactcctaacgaagagggttattgctctttcggagtttcctgcgactacacaaaggctgccgccgagtgcgctccggtagtagtagccgaggtgaacaagcaaatgccattcatcggtggtgaaaacctgattcacatctccaaactgacccatatcatcgaagtggacgagccgattgcagaagtattgcctcctgctatcagcgaccttgaactgaggataggtcagaattgtgcctcactgatcaaagacggcgataccctccagttgggtatcggcggtatccccgacgctgtgttgcgtgcattggaagggcataaagatctcggtattcacacggaaatgtttaccgacggggtgatgcgtatgattcgcaaggggattatcaacgggaagaaaaaaacattgcatcccgaaaaagtcgttacctcgctaatcttcggatcgaaagaattgtacgattttgtcaataacaatccggtgatagaatgctatccggtggattatatcaacaaccccgatgttatcggtaagaatgaccgcatggtttctatcaattcctgcttggagatggatctcatggggcaggcagcttctgagtcgatcgggtacgaacagttcagtggatccggaggtcaagtcgatttccttcgtggggccaagcgttccaagggaggaatctccattatggctttccccagtacggccaagaaagggactgagagtcgcatcgttcccattctgaaagagggtgcttgtgtcacgaccggccgtaacgaagtggactatgtggtgacggaatatggcgtagcgcgtctgcgtggcgcaacgcttcgtcagcgtgctgaagccttgactgctatagcacatcccgatttccgaccggcccttgaggaggaaatccgccgacgcttcgaataagtcggaaggattttaggccttatataaacggattcgaagccatgtacaactacattgtgtacatggcttcgtatgtttaacgtgagttcaatgtaagcgatatggtgccgattctctcttgatgggatattgactataaccgaatcagaaaatgaaagggaaaaagtttgacgtctcatcggacgtcggagcctctcgaagctgaaacctctcaacagacaaatgaaatacattgacaaacagcatattgcatgtttttcttggatcgaatccgcattgttttatagccgttcggaacatacgccgaaagggggtcgagctacgccctacagcgactcgggctacgccgtagagcgtaccgagctgcgctctacggctcttcgagctacgctgtagagcgtacctcgccgagctctacagcgtagctcgaagagccgtacgggatagctcgtcatcctctatggtgtaccgccatcttgcc

SEQ ID NO: 40 - protein, 431 aa, Porphyromonas gingivalis
MQWQELYRQRVCSADEAVVDSLKPGTKVVFGHAAAAPVRFSQAMYRQREKLENITVFHMLYFGDAPHLAPEMRSHVHPTLNFLEGNSRPASRDRRVDFIPCHFHEVPELFRQGFFPLDVAVVQVSTPNEEGYCSFGVSCDYTKAAAECAPVVVAEVNKQMPFIGGENLIHISKLTHIIEVDEPIAEVLPPAISDLELRIGQNCASLIKDGDTLQLGIGGIPDAVLRALEGHKDLGIHTEMFTDGVMRMIRKGIINGKKKTLHPEKVVTSLIFGSKELYDFVNNNPVIECYPVDYINNPDVIGKNDRMVSINSCLEMDLMGQAASESIGYEQFSGSGGQVDFLRGAKRSKGGISIMAFPSTAKKGTESRIVPILKEGACVTTGRNEVDYVVTEYGVARLRGATLRQRAEALTAIAHPDFRPALEEEIRRRFE

SEQ ID NO: 41 - DNA, 1497 bp, Porphyromonas gingivalis
  CDS (1)..(1497)
atggctctaagatttatcactgcagaagaagcagcggagtttgtgcatcacaacgacaatgtcggctttagcggttttacccctgcaggcaaccctaaggtagtacctgcggcaatagccaagcgagctattgcagcgcatgaaaaaggcaatcccttcaagatcggtatgttcaccggtgccagtaccggtgctcggttggacggtgtcttggcacaggccgatgctgtgaagtttcgtactccatatcagtccaataaggatctgcgcaatcttatcaacaatggcagcacttcctatttcgatcttcatctctctactttggctcaggatctgcgctatggcttttacggcaaggtggatgtggccatcatagaggtggcagacgttaccgaagacggtaagatcctgcctactacaggtgtaggtatcctgcctactatttgccgtctggcagaccgaatcatcgtggagcttaacgacaagcaccccaaagaaatcatgggtatgcacgacttgtgcgaacctctcgatccgcctgcccgtcgcgagctgcctgtctatactccttcggatcgtatcggcaagccttatgtacaggtggatccggccaagatagtcggtgtagtgcgtacgagcgaacctaatgacgagagcgattttgcgccccttgaccctgtaacgcaggctattggggacaatgtggctgctttcctcgtgagcgaaatgaaagccggacgaatacccaaagattttcttcccctgcaaagcggcgtaggcaatgtggctaatgccgtactgggagcgttgggtgacaatcccgatattccggctttcaacatgtacacagaggtaattcaggatgccgttatcgctctgatgaagaaaggacgcatcaagttcgccagcggatgttcgctctctgtgagtcgctccgtgatacaggacatctacgccaatctggatttcttcaaggacaagatcctccttcgtccgcaggaatactccaacaatcccgagatcgtccgccggttaggtgttatcaccatcaatacggctctcgaagcggatattttcggcaatatcaactctacgcacgttagcggtacgcgtatgatgaacggtatcggaggttcgggcgacttcactcgcaacagctacgtctccatcttcactacaccgtccgttatgaaggacggcaagatcagttctttcgtcccgatggtggcgcaccacgatcatagcgagcactccgtgaaagtcatcatttccgaatggggcgttgcagacttgcgaggcaagaacccacgtgagcgtgctcatgagatcatcgacaaatgtgtgcatcccgactatcgtcccctccttcgtcagtatctggagcttggagtcaaaggacaaacaccccagaatctggactgctgctttgccttccatcaggaattggccaagagcggcgacatgcgcaatgtacgctgggaagactacatgaagtaa

SEQ ID NO: 42 - protein, 498 aa, Porphyromonas gingivalis
MALRFITAEEAAEFVHHNDNVGFSGFTPAGNPKVVPAAIAKRAIAAHEKGNPFKIGMFTGASTGARLDGVLAQADAVKFRTPYQSNKDLRNLINNGSTSYFDLHLSTLAQDLRYGFYGKVDVAIIEVADVTEDGKILPTTGVGILPTICRLADRIIVELNDKHPKEIMGMHDLCEPLDPPARRELPVYTPSDRIGKPYVQVDPAKIVGVVRTSEPNDESDFAPLDPVTQAIGDNVAAFLVSEMKAGRIPKDFLPLQSGVGNVANAVLGALGDNPDIPAFNMYTEVIQDAVIALMKKGRIKFASGCSLSVSRSVIQDIYANLDFFKDKILLRPQEYSNNPEIVRRLGVITINTALEADIFGNINSTHVSGTRMMNGIGGSGDFTRNSYVSIFTTPSVMKDGKISSFVPMVAHHDHSEHSVKVIISEWGVADLRGKNPRERAHEIIDKCVHPDYRPLLRQYLELGVKGQTPQNLDCCFAFHQELAKSGDMRNVRWEDYMK

SEQ ID NO: 43 - DNA, 1296 bp, Porphyromonas gingivalis
  CDS (1)..(1296)
atgaaagacgtattagcggaatatgcctcccgaattgtttcggccgaagaagccgtaaaacatatcaaaaatggagaacgggtagctttgtcacatgctgccggagttcctcagagttgtgttgatgcactggtacaacaggccgaccttttccagaatgtcgaaatttatcacatgctttgtctcggcgaaggaaaatatatggcacctgaaatggcccctcacttccgacacataaccaattttgtaggtggtaattctcgtaaagcagttgaggaaaatagagccgacttcattccggtattcttttatgaagtgccatcaatgattcgcaaagacatccttcacatagatgtcgccatcgttcagctttcaatgcctgatgagaatggttactgtagttttggagtatcttgcgattatagcaaaccggcagcagaaagcgctcatttagttataggggaaatcaaccgtcaaatgccatatgtacatggcgacaacttgattcacatatcgaagttggattacatcgtgatggcagactaccctatctattctcttgcaaagcccaaaatcggagaagtagaagaagctatcgggcgtaattgtgccgagcttattgaagatggtgccacactccaactcggtatcggcgcgattcctgatgcagccctgttattcctcaaggacaaaaaagatctggggatccataccgagatgttctccgatggtgttgtcgaattagttcgcagtggagtaattacaggaaagaaaaagacacttcaccccggaaagatggtcgcaaccttcttaatgggaagcgaagacgtatatcatttcatcgacaaaaatcccgatgtagaactttatccggtagattacgtcaatgatccgcgagtaatcgctcaaaatgataatatggtcagcatcaatagctgtatcgaaatcgatcttatgggacaagtcgtgtccgaatgtataggaagcaagcaattcagcggaaccggcggtcaagtagattatgttcgtggagcagcatggtctaaaaacggcaaaagcatcatggcaattccctcaacagccaaaaacggtactgcatctcgaattgtacctataattgcagagggagctgctgtaacaaccctccgcaacgaagtcgattacgttgtaaccgaatacggtatagcacaactcaaaggaaagagtttgcgccagcgagcagaagctcttattgccatagcccacccggatttcagagaggaactaacgaaacatctccgcaaacgtttcggataa

SEQ ID NO: 44 - protein, 431 aa, Porphyromonas gingivalis
MKDVLAEYASRIVSAEEAVKHIKNGERVALSHAAGVPQSCVDALVQQADLFQNVEIYHMLCLGEGKYMAPEMAPHFRHITNFVGGNSRKAVEENRADFIPVFFYEVPSMIRKDILHIDVAIVQLSMPDENGYCSFGVSCDYSKPAAESAHLVIGEINRQMPYVHGDNLIHISKLDYIVMADYPIYSLAKPKIGEVEEAIGRNCAELIEDGATLQLGIGAIPDAALLFLKDKKDLGIHTEMFSDGVVELVRSGVITGKKKTLHPGKMVATFLMGSEDVYHFIDKNPDVELYPVDYVNDPRVIAQNDNMVSINSCIEIDLMGQVVSECIGSKQFSGTGGQVDYVRGAAWSKNGKSIMAIPSTAKNGTASRIVPIIAEGAAVTTLRNEVDYVVTEYGIAQLKGKSLRQRAEALIAIAHPDFREELTKHLRKRFG

SEQ ID NO: 45 - DNA, 1317 bp, Mycoplasma gallisepticum
  CDS (1)..(1317)
atgaattattttaaagcatataaaaataaattagtttctgtcaatcaggccatttcactaataaaaaataactcgaatatttggtttgattatctgcagccaaaactacttttacaggggctaaaagatacattagaaactaatagctactctaatttaaatttttattattatgcttctagctctgattgtgaagaaacaatctttttagacaaatttaatcaaatagttaaaagacattgttttttctacagagctaatgaaagaaatgctttaaagaaatatcaaaacggaatacttcaaaataacgttgaatactatccatttcatttctctgaatctactaagattcttaataattttgctatagatacggttattttaataactactgatattgatgaaaacggttattttaatttaggcttatccacttgttatgatttagatttaattaaaaaagcaaaacaagtaattattgaactcaataaaaatatgcctcatattatgggcgataagcatcaaattcacattaatgaggtagccgcaatagtcaaatctgactatcaactaactgaagcattaagtgttgatccaagtccagaacacttgaaaatagcagattatgtagcttcattaattcaagatcgttctacgattcaattgggtataggtgcaattcccaacatggtgtgcaaaaaacttgtaaataaaaaagacctaggaattcatacagaaatcctaggtactgggatggtcgaacttatcaaacttggggtggttaacaacaaatataaagaaattgaccaaggggtatcaacgtttgtatttgctgttggagaccaagatatgtacaaatatcttgatcataacgataaatttaaaattgcacgatttgattatgtaaataacccattaaatattgccaaattcgaaaactttatttcggttaattccgctatcgaaatagatttattaggtaatgttaacgctgaacaaattcagcataaccaatattcgggttctggtggacaagcagattttattagaggtgctagctactctaaaaatggtaagagtatcattgcaatgaaatcaacaactagtgattgcaaaatttctaagattgtaaccaaacttaaaggggttacaacgacattaagaaatgatttagattatgtaatcaccgaatatggaattattagcttaaaagctaaatcagtaaaacaacgcgcaaaattgttaattagtattgctcatcctaagtttagatcttatttaactagagttgctagatctaaactacttattgattaa

SEQ ID NO: 46 - protein, 438 aa, Mycoplasma gallisepticum
MNYFKAYKNKLVSVNQAISLIKNNSNIWFDYLQPKLLLQGLKDTLETNSYSNLNFYYYASSSDCEETIFLDKFNQIVKRHCFFYRANERNALKKYQNGILQNNVEYYPFHFSESTKILNNFAIDTVILITTDIDENGYFNLGLSTCYDLDLIKKAKQVIIELNKNMPHIMGDKHQIHINEVAAIVKSDYQLTEALSVDPSPEHLKIADYVASLIQDRSTIQLGIGAIPNMVCKKLVNKKDLGIHTEILGTGMVELIKLGVVNNKYKEIDQGVSTFVFAVGDQDMYKYLDHNDKFKIARFDYVNNPLNIAKFENFISVNSAIEIDLLGNVNAEQIQHNQYSGSGGQADFIRGASYSKNGKSIIAMKSTTSDCKISKIVTKLKGVTTTLRNDLDYVITEYGIISLKAKSVKQRAKLLISIAHPKFRSYLTRVARSKLLID

SEQ ID NO: 47 - DNA, 1578 bp, Neurospora crassa
  CDS (1)..(1578)
atggcgtcgcccattgcctcggcggccctcagggcccgcgtcaagcgcccttccatgctcaagaagctctgcaaccccgaggacatgctccagcacttccccaatggcgcatacatcggctggtccggtttcaccggcgtcggctaccccaagaaggtccctactatgctcgctgaccacgtcgagaagaacggcctccagggccagctcaagtacagcctcttcgtcggtgcctccgccggcgccgagaccgagaaccgctgggctgctctcgacatgatcgcccgtcgcgctcctcaccaggtcggcaagaacattgccaagggcatcaacgagggccgcatcaacttcttcgacaagcacttgtccatgttccccgttgaccttgtctacggctactacaccaaggaccgccagaacaagaacctcgatgtcgtttgcgttgaagctaccgagatcaaggaggacggttccatcgtcctcggtgcctcggtcggtgccacccccgagctcatccagatggccgacaaggtcatcattgaggtcaacacggccatccccagcttcgacggtctccacgacatcaccttctccgacctccctcccaaccgcaagccctacctcatccagcagtgcagggaccgcatcggtactacttcggtccccgtcgaccccgagaaggttgtcggtatcatcgagtgcaccacccccgatcagaccctccccaactcccccgccgacgaaacggctacggccattgccggccacctgattgagttcttcgagcacgaggtcgcccacggccgtctgcccaagaaccttctccctctgcagtccggtatcggcaacatcgccaacgccgtcattggtggtctcgagacctccaacttcaagaacctcaacgtctggactgaggttatccaggataccttcctcgacctcttcgactccggcaagcttgactttgctaccgccacctcgatccgcttctcgcccaccggcttcgagcgcttctacaagaactgggacaactactatgacaagctcctcctccgctctcagtccgtctccaacgctcccgagatcatccgccgtctcggtgttatcggcatgaacacccccgtcgaagtcgacatctacgcccacgccaactccaccaacgtcatgggctcccgcatgctcaacggtctcggtggttccgccgatttcctccgcaactccaagtactccatcatgcacaccccctccacccgtccctccaagaccgacgcccacggtgtttcgtgcattgtccccatgtgcacccacgtcgaccagaccgagcacgatctcgacgtcatcgttaccgagaacggtctcgccgatgtccgcggcctcagcccccgcgagcgtgcccgcgtcatcattgacaagtgcgcccacgacgtctacaagcccatcctcaaggcctactttgagaaggccgagttcgagtgccttcgcaagggtatgggccacgagccccaccttctcttcaactctttcgacatgcacaaggctcttgtcgaggagggctccatggccaaggtcaagttctaa

SEQ ID NO: 48 - protein, 525 aa, Neurospora crassa
MASPIASAALRARVKRPSMLKKLCNPEDMLQHFPNGAYIGWSGFTGVGYPKKVPTMLADHVEKNGLQGQLKYSLFVGASAGAETENRWAALDMIARRAPHQVGKNIAKGINEGRINFFDKHLSMFPVDLVYGYYTKDRQNKNLDVVCVEATEIKEDGSIVLGASVGATPELIQMADKVIIEVNTAIPSFDGLHDITFSDLPPNRKPYLIQQCRDRIGTTSVPVDPEKVVGIIECTTPDQTLPNSPADETATAIAGHLIEFFEHEVAHGRLPKNLLPLQSGIGNIANAVIGGLETSNFKNLNVWTEVIQDTFLDLFDSGKLDFATATSIRFSPTGFERFYKNWDNYYDKLLLRSQSVSNAPEIIRRLGVIGMNTPVEVDIYAHANSTNVMGSRMLNGLGGSADFLRNSKYSIMHTPSTRPSKTDAHGVSCIVPMCTHVDQTEHDLDVIVTENGLADVRGLSPRERARVIIDKCAHDVYKPILKAYFEKAEFECLRKGMGHEPHLLFNSFDMHKALVEEGSMAKVKF

SEQ ID NO: 49 - DNA, 1533 bp, Bordetella pertussis
  CDS (1)..(1533)
atgtctggagacagcatgcatctcgaacgtattcgccatcccggcctgcgcgcccggttggcttccccccaggaagcggcccggctggtccacgacggcatgaccgtcggcatgagtgagttcacgcgcgcgggcgactgcaaatcggtgccggcggcgctggccgaaagagccgccgccgagccgctgcgcatcacgctgctgaccggcgcctcgctggggcatgacaccgacaagctgctggcgcaggccggcgttctggcgcgccgcatgccgttccaggtcgacaccacgctgcggcgcaagatcaaccagggcgagatcgcctttgtcgaccagcacttgtccgaaaccgtcgagcagttgcgcgccggccatatcggccccatcgacatcgccatcgtcgaggcggctgccatcaccgaagacggcggcatcgtgccgaccatgtcggtcggcaactcggcctcgttcgtcgagcaggcccgcctggtcatcgtcgagctcaatctcggcgtgcccgcggccatcgaaggcctgcacgacatcgtgatcccgggcgcgcggcccggccgccagcccctgccgctggtgtcggtcgaccagcgcatcggcgcgccctgcatcgcggtggaccccgacaagatcgccgccatcgtcgtcaccaacgaaccggacagtccctcaaacgccttgccgcccgacgaggagatcggcgccatcgccggccacatcgtcggcttcctgcgccaggaagtgaaccaggggcgcctgagccgctcgctgctgcccctgcaggccggcatcggcacgatcgccaatgccgtgctgcacgggttcggcgagtcggaattcgaggggctcaccatgtactcggaagtgctgcaggacagcgcgatcgaactcctggaccagggcaagctgagtttcgcctcggcctcgtccatcacggtctcgctgccggtgtacgaacgcatcctgggcaacctcgagcactaccgccagcgcatcgtgctgcgcccgcaggaaatcagcaacgcgcccgagctggtgcgccgcctgggcgtgattgccatcaacacggcgctggagttcgacatctacggcaacgtcaactccacccatgtgggcggcacccatatgatgaacggcatcggcggttcgggggactttgtgcgcaacgcgcacctgtccatcttcgtgaccaagtccatggccaggaacggcgatatttccagcgtggtgcccatggtctcgcatgtggaccacaacgagcacgacgtcgatatcctggtgaccgagtgcgggctggcggacctgcgcggcctggcgccgcgcgagcgcgctcgcgccatcatcgcccattgcgtgcatccctcgtaccgcgatgcgctgcgcgattacttcgagcgcgcctgcaggcgcggcgggcaaacgtcccatctgctggaggaggccttctcctggcaccagcgctacaacgaaaccgacacgatgcggctggcggcaccggcggcccggcgcgtggcctga

SEQ ID NO: 50 - protein, 510 aa, Bordetella pertussis
MSGDSMHLERIRHPGLRARLASPQEAARLVHDGMTVGMSEFTRAGDCKSVPAALAERAAAEPLRITLLTGASLGHDTDKLLAQAGVLARRMPFQVDTTLRRKINQGEIAFVDQHLSETVEQLRAGHIGPIDIAIVEAAAITEDGGIVPTMSVGNSASFVEQARLVIVELNLGVPAAIEGLHDIVIPGARPGRQPLPLVSVDQRIGAPCIAVDPDKIAAIVVTNEPDSPSNALPPDEEIGAIAGHIVGFLRQEVNQGRLSRSLLPLQAGIGTIANAVLHGFGESEFEGLTMYSEVLQDSAIELLDQGKLSFASASSITVSLPVYERILGNLEHYRQRIVLRPQEISNAPELVRRLGVIAINTALEFDIYGNVNSTHVGGTHMMNGIGGSGDFVRNAHLSIFVTKSMARNGDISSVVPMVSHVDHNEHDVDILVTECGLADLRGLAPRERARAIIAHCVHPSYRDALRDYFERACRRGGQTSHLLEEAFSWHQRYNETDTMRLAAPAARRVA

SEQ ID NO: 51 - DNA, 1515 bp, Bacillus cereus
  CDS (1)..(1515)
atggagaacaatttagatagaatcagagatcaacgtctaaaagatcgggtagttacacctgaagaagcagcttcctggattcaaagtggaatgactttaggcttaagtgggtttacacgtgcaggtgatgtaaaagcagtcccatttgcgcttgtaaaccgagttaagaatgatgaatcttttaaagtaaatgtttatactggggcttctttaggatcggatgtagacaaattatttgctgaggcaggaattttagggaaaagattacctttccaagctgacgctactatgcgaaaaggaattaataacggagactttttatttgtggatcaacacttgtctcatacagcagagttactccgtgctgacgttctggatatagatttcgctattttggaagcggttgcgattacagaggacggaatgattattccaaccacttcaattggaaattccttagcgttttccttaaatgctaagtctattattattgaaatgaatatggctcaatccgcgcaattagaggggctacatgatctatatgaaccaggtaaacaaggggagaggcttccaattccgcttgtgaaaacagatgaccgaattggaacaatcggtattccaattgatcctgaaaaagtaaagggaattgtgtttacgaatcaattggattcgccatcgacaattgttcctccggatgaagaaactgttattatggcacagcatttaatagaattccttcgagaagaagtcaaagtaggccgattaacaaatcgtttagcgccgttacaatcaggaattggttcagtggctaacgccgtattgcatggaatgttagattcagaatttgaagatttagaagtatattccgaggttttacaagatgcagtttttgatcttatggatgctggaaaagtcaattttgcttcttgttgttctatcacgctttctgaagagaaaatgcaacaagtattttctaactttgaaaaatatcgtgacaaattaatgatgcgtccacaagagatttccaatcatcctgaaattattcgtcgccttggattaatctcaattaatactgcattagaattagatatatacggaaatgttaactctactcacgttttaggtacaaaaatgatgaatggtattggtgggtctggtgattttgcaagaaatgctcgcctagctatctttgttactaaatcgattgcgaaaggtggtaacatttcaagtatcgttcctttcgtttctcatgtagaccatactgaacatgatgtagatgttatcgtcactgaacagggatatgccgacttaaggggacttgcgccaagagaaagagtggaacttattattgagaattgcgcacatccaatgtatcgtgaacagctacgagcttattacgaagaagcaaaaataagaggtggacaaactcctcatattttagaaaaagctttttcttggcatacgaactatgctaaaaatggaacaatgcttgaagcggtagtagaaactgtatag

SEQ ID NO: 52 - protein, 504 aa, Bacillus cereus
MENNLDRIRDQRLKDRVVTPEEAASWIQSGMTLGLSGFTRAGDVKAVPFALVNRVKNDESFKVNVYTGASLGSDVDKLFAEAGILGKRLPFQADATMRKGINNGDFLFVDQHLSHTAELLRADVLDIDFAILEAVAITEDGMIIPTTSIGNSLAFSLNAKSIIIEMNMAQSAQLEGLHDLYEPGKQGERLPIPLVKTDDRIGTIGIPIDPEKVKGIVFTNQLDSPSTIVPPDEETVIMAQHLIEFLREEVKVGRLTNRLAPLQSGIGSVANAVLHGMLDSEFEDLEVYSEVLQDAVFDLMDAGKVNFASCCSITLSEEKMQQVFSNFEKYRDKLMMRPQEISNHPEIIRRLGLISINTALELDIYGNVNSTHVLGTKMMNGIGGSGDFARNARLAIFVTKSIAKGGNISSIVPFVSHVDHTEHDVDVIVTEQGYADLRGLAPRERVELIIENCAHPMYREQLRAYYEEAKIRGGQTPHILEKAFSWHTNYAKNGTMLEAVVETV

SEQ ID NO: 53 - DNA, 1515 bp, Bacillus anthracis
  CDS (1)..(1515)
atggagaataatttggatagaattagggatcaacgtctgaaagatcgcgtagttacacctgaagaagcagcttcatggattgaaagtggaatgactttaggcttaagtgggtttacacgtgcaggtgatgtgaaagcagtcccatttgcgcttgtaaaccgagttaagaatgatacatcttttaaagtaaatgtttatactggtgcctctttaggttctgatgtagataaattatttgcggaagcaggaattttagggaaaagattgcctttccaagctgatgcgactatgcgaaaaggaattaataacggagattttttatttgtagaccagcacttatctcatacagcagagttacttcgcgctgacgttatggatgtagattttgctattttgggagcggttgcgattactgaagatggcatgattattccaacaacttcaataggaaattctttagcgttttctttaaatgctaagtctatcattattgaaatgaatatggcccaatccgcgcagctagaagggctacatgatttatatgaaccaggtaaacaaggagaaagacttccaattccactcgtaaaaacaaatgatcgaattgggacgattggcattccgattgatgttgaaaaagtgaaagggattgtatttacgaatcaattggattcaccatcaacaattgttcctccagatgaagaaactgttattatggcacagcatttaatagaatttcttcgaaaagaagtcgaagtaggccgattaacaaatcgtttagcaccgttacaatcgggaattggttcagtagctaatgcagttcttcatggaatgttagattcggagtttgaagatttagaagtgtattctgaagttttacaggatgcggtctttgatcttatggatgctggaaaagtcaattttgcttcatgctgttcgatcacactttctgaggagaaaatgcaaaaagtattttccaactttgaaaaatatcgtgacaaattaatgatgcgcccgcaagagatttccaatcatcctgaaattattcgccgcctcggattaatctcgattaatactgctttagaattagatatatacggaaatgtgaactctactcacgttttaggtacaaaaatgatgaacggtatcggtggttctggtgactttgcaagaaatgctcgtttggctatctttgttactaaatcgattgcgaaaggtggtaacatttcaagtatcgttcctttcgcctcacatatagaccatacggaacatgatgtagatgttatcgtcactgagcaaggatatgctgacttaagaggacttgcgccaagtgaaagagtggaactcattattgagaattgtgcacatctaatgtatcgtgatcaactacgagcttattatgaggaagcgaaaacaagaggtggacaaactcctcatattttagagaaagctttttcttggcatacgaattatgctaaaaatggaacgatgcttgaagaggtagtagaaactgtatag

SEQ ID NO: 54 - protein, 504 aa, Bacillus anthracis
MENNLDRIRDQRLKDRVVTPEEAASWIESGMTLGLSGFTRAGDVKAVPFALVNRVKNDTSFKVNVYTGASLGSDVDKLFAEAGILGKRLPFQADATMRKGINNGDFLFVDQHLSHTAELLRADVMDVDFAILGAVAITEDGMIIPTTSIGNSLAFSLNAKSIIIEMNMAQSAQLEGLHDLYEPGKQGERLPIPLVKTNDRIGTIGIPIDVEKVKGIVFTNQLDSPSTIVPPDEETVIMAQHLIEFLRKEVEVGRLTNRLAPLQSGIGSVANAVLHGMLDSEFEDLEVYSEVLQDAVFDLMDAGKVNFASCCSITLSEEKMQKVFSNFEKYRDKLMMRPQEISNHPEIIRRLGLISINTALELDIYGNVNSTHVLGTKMMNGIGGSGDFARNARLAIFVTKSIAKGGNISSIVPFASHIDHTEHDVDVIVTEQGYADLRGLAPSERVELIIENCAHLMYRDQLRAYYEEAKTRGGQTPHILEKAFSWHTNYAKNGTMLEEVVETV

SEQ ID NO: 55 - DNA, 1494 bp, Pseudomonas syringae
  CDS (1)..(1494)
atgtaccgtgaccgtatccgcctgccctccctgatgagcaaggttatgagcgcagccgatgctgctgcattgattgaagacggcatgaccgtcggcatgagcggcttcacccgcgcaggcgaagccaaggccgtgcctcatgcgctggccgagcgcgccaaggtgacacccctgaaaatcagcctgatgacgggtgccagcctgggcaatgacctggacaagcaactgaccgaatccggcgtgctgtcccggcgcatgccgtttcaggtcgacagcactctgcgcaaggcgatcaacaacggcacggtgatgttcatcgaccagcatttgtccgataccgtcgagttgttgcgcaatcggcagatcaaggccgtggacctggcggtgatcgagtgtgtggcaattaccgaggaaggccacctggtgctgagcacctccgttggcaactcggccagtttcgctattctggccaaacaggtcatcgtggaaatcaacctgtcccagcctctggagctggaaggcctgcatgacatctatatacccagctaccggccgacgcgcctgccgatcccggtgctggaagccgattcgcgcatcggcagccatgcggtgaagatcgacccggcgaagatcgtcggcatcgttatcagcaaccagcctgactcgccttccaccgtcacgccacctgacgcagacactcaggccatcgccaaccacctggtggagttcttcaagaaggaggtgcgcgaagaccggctcaccgacaaactgatgcccctgcaggcgggcattggcaacatcgccaacgcagtcatgcatggcctgctggaatcgccattcactgacctgaccatgtattccgaagtattgcaggactcgacattcgacctgttcgacgccggcaaactgacatttgcttccggcagctccatgaccctgtcagcggccaaacacgccgaagtatttgccgacttcaaccgctataaatccaggctggtgctgcgcccgcaggaaatatccaatcaccccgaagtcatccggcgcctggggattatcgggatcaataccgcgctggagttcgatctgtacggcaacgtcaactccacccacatctgtggcacgcggatgatgaacggcattggcggctctggggatttttcgcgcaacgcgcacctggcgatattcgtcaccaagtcgattgccaagggcggtgccatttccagcgttgtgccgatggtcagccatgtcgaccacaccgagcatgacgtcgacattctggtgaccgagcaggggctggccgatttacgcgggctggcacctcgcgagcgggcgcgggtgatcatcgataactgcgtacatgctgattatcgcgatgcgttgaacgcctatttcgacgccgcctgcgcgctgggcgggcatacgccgcacatccttcgggaagcactgagttggcacatcaacctggaagaaaacgggcgcatgctgccgacctga

SEQ ID NO: 56 - protein, 497 aa, Pseudomonas syringae
MYRDRIRLPSLMSKVMSAADAAALIEDGMTVGMSGFTRAGEAKAVPHALAERAKVTPLKISLMTGASLGNDLDKQLTESGVLSRRMPFQVDSTLRKAINNGTVMFIDQHLSDTVELLRNRQIKAVDLAVIECVAITEEGHLVLSTSVGNSASFAILAKQVIVEINLSQPLELEGLHDIYIPSYRPTRLPIPVLEADSRIGSHAVKIDPAKIVGIVISNQPDSPSTVTPPDADTQAIANHLVEFFKKEVREDRLTDKLMPLQAGIGNIANAVMHGLLESPFTDLTMYSEVLQDSTFDLFDAGKLTFASGSSMTLSAAKHAEVFADFNRYKSRLVLRPQEISNHPEVIRRLGIIGINTALEFDLYGNVNSTHICGTRMMNGIGGSGDFSRNAHLAIFVTKSIAKGGAISSVVPMVSHVDHTEHDVDILVTEQGLADLRGLAPRERARVIIDNCVHADYRDALNAYFDAACALGGHTPHILREALSWHINLEENGRMLPT

SEQ ID NO: 57 - DNA, 1494 bp, Pseudomonas putida
  CDS (1)..(1494)
atgtaccgtgatcgtatccgcttgtcctccctgcacagcaaggtaatgagtgcggctgatgccgctggtctgatcgaggacggcatgactgtcggcatgagcggcttcacccgcgccggcgaagccaaggccgtaccgcatgcattggccgaacgtgccaagcaatcgccactgaaaatcagcctgatgaccggcgccagcctgggcaatgacctggacaaacaactgaccgaggccggtgtgttggcccgccgcatgccgttccaggtcgacagcaccctgcgcaaagccatcaatgacggccaggtgatgttcattgaccagcacctgtcggaaaccgtcgagcaactgcgcaaccagcagctgaagctgccggacatcgcggtcatcgaagccgtggccatcaccgagcaaggccacatcgtgccaaccacttcggtgggcaactcggccagcttcgcgatcttcgccaagcaggtgattgtggagatcaacctctcgcacaacaccaacctcgaaggcctgcacgacatctatatcccaacctaccgcccgactcgcacgccaatcccgctggtcaaggtagacgaccgtatcggcagcaccgcgatcccgatcgatccggccaagatcgtcggtatcgtcatcagcgaccagccggactcgccgtccactgtgctgccgccagatgatgaaacacagggcatcgccgaccacctgatcaacttcctcaagaaggaagtggatgcaggccgtatgaccaacaagctcggcccgctgcaagccggcattggcagcattgccaatgcggtgatgtgcggcctgatcgagtcgccgttcgaagacctgaccatgtactccgaagtgctgcaggactccaccttcgacctgatcgatgccggcaagcttagcttcgcatccggcagctcgatcaccctgtcgacgcgccgcaatgccgatgtgttcggcaacctggagcgctacaaggacaagctggtgctacgcccgcaggaaatctccaaccacccggaagtggtacgtcgcctgggcatcatcggtatcaacaccgcactggagttcgatatctacggcaacgtcaactccacccacgtctgtggcaccaggatgatgaacggcatcggtggctccggcgacttcgcccgtaacgcccacctggcagtgttcgtcaccaagtcgattgccaaaggcggggcgatttccagcgtggtgccaatggtcagccatgtcgaccacaccgagcacgacgtggacatcctggtcaccgagcagggcttggcggacctgcgtggcctggcgccgcgcgaacgggcgcgagcgatcatcgacaactgtgtgcacccagactatcgcgctgcgctgaacgactacttcgaccgcgcctgccagcgtggcggccataccccgcacatcctgcgcgaagccctgagctggcacgaaaacctggaagaaaccgggcgcatgctggccagctga

SEQ ID NO: 58 - protein, 497 aa, Pseudomonas putida
MYRDRIRLSSLHSKVMSAADAAGLIEDGMTVGMSGFTRAGEAKAVPHALAERAKQSPLKISLMTGASLGNDLDKQLTEAGVLARRMPFQVDSTLRKAINDGQVMFIDQHLSETVEQLRNQQLKLPDIAVIEAVAITEQGHIVPTTSVGNSASFAIFAKQVIVEINLSHNTNLEGLHDIYIPTYRPTRTPIPLVKVDDRIGSTAIPIDPAKIVGIVISDQPDSPSTVLPPDDETQGIADHLINFLKKEVDAGRMTNKLGPLQAGIGSIANAVMCGLIESPFEDLTMYSEVLQDSTFDLIDAGKLSFASGSSITLSTRRNADVFGNLERYKDKLVLRPQEISNHPEVVRRLGIIGINTALEFDIYGNVNSTHVCGTRMMNGIGGSGDFARNAHLAVFVTKSIAKGGAISSVVPMVSHVDHTEHDVDILVTEQGLADLRGLAPRERARAIIDNCVHPDYRAALNDYFDRACQRGGHTPHILREALSWHENLEETGRMLAS

SEQ ID NO: 59 - DNA, 1314 bp, Clostridium tetani
  CDS (1)..(1314)
atgaattgggaagatatttacaaaagtaagctattatcatcaaaggaagctgttttaaaattaaaatctgaaaaccacgtagcagttggacatgctgctagtgaacctagacttttaatgaaagctttagttgataataaggaaagttttagagatttaaaactttatcaaatgatagctttagaaaagagtgaatgtgctaaaaaaggtatggaaaaacattttagttataattctctttttgtaggaggagggagtagggaagctataaatgatggaagagctgattatattccttgttttttttcaaggataccaagactttttagagagaactatataaaattagatgcggcattaatacaagttgcacctccagatgagcatggattttgtagctttggtgtttcttctgattatataaaacctgcagcagaatgtgcaaaacttgttattgcagaagtaaatgataagatgccaagaactttaggggataattttatacatgttagtgacatagattatatagttgaaaattctcgagagataccagagctaaaaccttctaatataggtgatatagaaagggcaataggagaaaattgtgcatctcttataaataatggagatgttttgcaattgggcataggtgcaattccagatgcagtacttttatttttaaaggataaaaaggatttaggaatacattcagagatgatttctgatggggtggtagatttagtaaaggcaggggtaataaataataagaaaaagactttgcatcaagggaagataattgttagttttttaatgggaacaaagaaattatatgattttgtggataataatcctatggtgagaatgtaccctgtggattatgttaataatcctgtagttattagtaaaaatgataatatggtctctataaattcctgtattcaaatagatcttatgggtcaaatagatgcagaaaccataggctttacccaaataagtggtgttggtggacaaatagattttataagaggagcaggtcttagtaaaaatggaaggtctatcattgcaataccttctactgtaggaaatggaaaaatatctaaaatagttcctctattagataaaggagcagcagtaactaccacaagaaatgaagtggattatgtagttactgaatacggaattgcaagacttaaaggtaaaaatttaagggacagggcccgagaacttattaaaatagctcatcctgattttagagaggaattaaaattagaatataagaatagatttaaagaagagtttaaaagaataggataa

SEQ ID NO: 60 - protein, 437 aa, Clostridium tetani
MNWEDIYKSKLLSSKEAVLKLKSENHVAVGHAASEPRLLMKALVDNKESFRDLKLYQMIALEKSECAKKGMEKHFSYNSLFVGGGSREAINDGRADYIPCFFSRIPRLFRENYIKLDAALIQVAPPDEHGFCSFGVSSDYIKPAAECAKLVIAEVNDKMPRTLGDNFIHVSDIDYIVENSREIPELKPSNIGDIERAIGENCASLINNGDVLQLGIGAIPDAVLLFLKDKKDLGIHSEMISDGVVDLVKAGVINNKKKTLHQGKIIVSFLMGTKKLYDFVDNNPMVRMYPVDYVNNPVVISKNDNMVSINSCIQIDLMGQIDAETIGFTQISGVGGQIDFIRGAGLSKNGRSIIAIPSTVGNGKISKIVPLLDKGAAVTTTRNEVDYVVTEYGIARLKGKNLRDRARELIKIAHPDFREELKLEYKNRFKEEFKRIG

SEQ ID NO: 61 - DNA, 1500 bp, Bacteroides thetaiotaomicron
  CDS (1)..(1500)
atgtcattcaatcgtatttcggcagcagaagctgcaagcctgatcaaacatggctacaacatcggtctgagcggatttactcccgccggaactgcaaaggctgttacagctgaacttgcaaaaattgcagaagcggaacatgccaaaggtaatccatttcaagtaggaatttttacaggtgcttctaccggagaatcttgtgacggcgttatgtctcgcgcaaaggccatccgctaccgcgccccttataccaccaactccgacttccgcaaagccgtgaataacggtgaaattgcctacaacgacatccatctgtcgcaaatggcacaggaagtgcgctatggcttcatgggcaaagtgaacgtagccatcatcgaagcctgcgaagtgactccggacggaaagatttatctgactgctgccggtggtatttctccgactatctgccgcctggcggaccagatcatcgttgagttgaacgccgcacacagcaaatcctgcatgggtctgcacgacgtgtacgaaccgctcgacccgccttaccgccgcgaaatccccatctacaagccgagtgaccgcatcggattgccttatattcaggtagacccgaaaaagatcgtaggcgtagtagaaaccaactggccggacgaagcacgctcatttgccgatgccgatccgttgactgacaaaatcggtcagaacgttgccgacttcctcgctgccgacatgaagcgtggcatcattccgtctactttccttccgctgcagtcgggcgtaggaaatatcgctaacgctgtgctcggtgcactgggacgtgacaagacgattcccgcattcgaaatgtacacagaggttatccagaactccgtcatcggattgatccgtgaaggacgcatcaaattcggtagcgcctgctcactgactgttaccaacgactgtctggaaggtatttacaacgatatggatttcttccgcgacaagctggttctccgcccgtcggaaatctcaaacaatccggaagtggttcgccgactgggtattatctctatcaatacagctatcgaagtggacttgtacggtaacgtaaactctactcatatcggtggaacgaagatgatgaacggtatcggtggctcgggagacttcacccgcaatgcttatatctctatcttcacttgtccgtctgttgccaaagaaggtaagatcagtgctatcgtcccgatggtttctcacctcgaccacagcgaacactccgtgaatatcattatcaccgagcaaggtgtagccgacctgcgtggcaagagcccgaaggaacgtgcacaagccatcatcgaaaactgtgcacatcccgactataaacagcttctctgggattatctcaaactggccggtggcagggcgcagactccacacgctatccaggccgcactcggtatgcacgccgaactggccaagagcggggatatgaagaatacgaattgggcggagtatgccagataa

SEQ ID NO: 62 - protein, 499 aa, Bacteroides thetaiotaomicron
MSFNRISAAEAASLIKHGYNIGLSGFTPAGTAKAVTAELAKIAEAEHAKGNPFQVGIFTGASTGESCDGVMSRAKAIRYRAPYTTNSDFRKAVNNGEIAYNDIHLSQMAQEVRYGFMGKVNVAIIEACEVTPDGKIYLTAAGGISPTICRLADQIIVELNAAHSKSCMGLHDVYEPLDPPYRREIPIYKPSDRIGLPYIQVDPKKIVGVVETNWPDEARSFADADPLTDKIGQNVADFLAADMKRGIIPSTFLPLQSGVGNIANAVLGALGRDKTIPAFEMYTEVIQNSVIGLIREGRIKFGSACSLTVTNDCLEGIYNDMDFFRDKLVLRPSEISNNPEVVRRLGIISINTAIEVDLYGNVNSTHIGGTKMMNGIGGSGDFTRNAYISIFTCPSVAKEGKISAIVPMVSHLDHSEHSVNIIITEQGVADLRGKSPKERAQAIIENCAHPDYKQLLWDYLKLAGGRAQTPHAIQAALGMHAELAKSGDMKNTNWAEYAR

SEQ ID NO: 63 - DNA, 1287 bp, Shewanella oneidensis
  CDS (1)..(1287)
atgcctgcgattgtgtgtcaaagtgccctcgaagcggtttcgttaatccgaagtggtgaaacactctggacccattccatgggggcaaccccaaaagtgttattggatgcgctggcaaaacatgcgctcactctcgataatattacgttattacagttacatactgaaggtgctgagtccttaagtcatccaagtttattgggacatttacgccaccgttgttttttcggtggtgtgcctacaaggccgttattgcaaagtggtgatgccgattatgtgccgattttcctctcggaagtgcccaaactgtttcgtagcggcgagcaaaaaattgataccgcgattattcaagtatcgccacctgataaacacggcatgtgttccttaggcatttcggttgaggcgaccttagccgcttgccaagtggcgggtaagattattgcccatatcaatccgcaaatgccgcgcacccatggcgatggctttatccatatcgatcgttttgccgcagtgtatgagcaaagcgccagtttgcctatccattcctttgccacaggcgatgccgtgagtttggccataggtcagcatgtggccgaattagtccgcgatggagactgtttgcaaatgggcattggcgccattcccgatgcggtgttgtcctgtttgactggccacaaggacttaggtgttcacactgagttattttccgacgggattttgcaattggttgaaaagggcgtgattaacaacactaaaaaacgcttttatcccggaaaactggttaccggtttcgccctaggtagccagaagttatacgactatgtggatgataatccagcggttatctttatggatatcgagcaagtcaacgacacgtctattatccgtaaaaaccccaatgtaatggcgattaactcggcgttgcaggtcgatctcaccgggcaagtgtgtgccgattccattggcactaagatttattcgggcgtgggtggccagatggactttatccgtggcgcgggcttatctgaaggcggccgctctgtgattgcgctgccaagtactgcggcgggggggcgtatttctcgtatcgctagcgtgttatctcctggggctggcgttgtaactacacgtgcccatgtgcattacatagtgactgaatatggcgcagctaatctgaaggggcgatccctacgtgaaagggcgcaggccttgattaatatcgcccatccggattttagagagcaactgagtcgcgacgcctttgaagtatggggattaaatttatag

SEQ ID NO: 64 - protein, 428 aa, Shewanella oneidensis
MPAIVCQSALEAVSLIRSGETLWTHSMGATPKVLLDALAKHALTLDNITLLQLHTEGAESLSHPSLLGHLRHRCFFGGVPTRPLLQSGDADYVPIFLSEVPKLFRSGEQKIDTAIIQVSPPDKHGMCSLGISVEATLAACQVAGKIIAHINPQMPRTHGDGFIHIDRFAAVYEQSASLPIHSFATGDAVSLAIGQHVAELVRDGDCLQMGIGAIPDAVLSCLTGHKDLGVHTELFSDGILQLVEKGVINNTKKRFYPGKLVTGFALGSQKLYDYVDDNPAVIFMDIEQVNDTSIIRKNPNVMAINSALQVDLTGQVCADSIGTKIYSGVGGQMDFIRGAGLSEGGRSVIALPSTAAGGRISRIASVLSPGAGVVTTRAHVHYIVTEYGAANLKGRSLRERAQALINIAHPDFREQLSRDAFEVWGLNL

SEQ ID NO: 65 - DNA, 1515 bp, Oceanobacillus iheyensis
  CDS (1)..(1515)
atggaagaaaaattaaagcgcatacaaaacaaggaattagggcaaaaagtggtaactgcagcagaagcagcttcttggattaaagatggtatgacattggggcttagtggatttacacgtgcgggagatgcaaaggcggttccgactgcgctggtgaaaagagcggaagcgggagaatccctcaaagtcaatgtatacacaggggcatctttaggatctaatatcgataagctgtttgcagaagcaggaatcgttaataaaagaattccatttcaggctgagccatctatgcgtaaggcaataaatgctggggaacatttatttgtcgaccaacacctttcacacacatcagaaatgcttcgtggtgatgcgatggaggctgtcgattatgccataatagaagcaatttctgtaacagaaaatggttatattattccaagtacatcagtaggtaactcagttgcatttgctgaaactgccgataacattattattgaactcaatactgcgcaaccaatggaattagaaggaatgcatgatatttatggtcctgggaaacaaggagatcgtgatccgattccattaaaagaggtcgatcagcgtattggtaaggtcggtattcaggttgatacggataaaattaaggggatagtttttacgcatcaacctgattcagcttcgacaattgttccgccagatgaggagacgcaacaaattgcgaaccatctactgaatttctttagggaggagattcaggcaggacgattaacagagaagcttatgccattgcagtccggaataggttctgttgctaatgccgtattacatggtatgctagactctgagtttaaagatttgacggtttattctgaagtgcttcaagatgctgtcttcgatttgattgatgcaggtaaagtgagctttgcttctgcatgttccattacgttatcagaagacaagatgaagcatgtgtttagtaatctagcggaatatcagagtaagcttgtcttacgtccgcaagaaatctcgaatcatccagaaatcattcgtcgactgggtctaattgcgattaacacagcattagaatttgatatttacggcaatgtgaactctacacacgttggcggaacgaaaatgatgaacggtattggtggttcaggcgattttgctagaaatgctagattggggatttttgttacaaagtcgattgcgaaaaatggcgatatatctagtatcgttccatatgtatcgcatacagatcataccgaacacgatgtagatgtaattgttacggaacaaggttatgcagaccttcgtggattagcaccacgagaacgagtgccgcaaattattgaaaattgtgtgcatcctttatataaggaagcgttatgggagtattaccaagaagcgctagaacggggtgggcagactccgcatgttctagaaaaagctttttcttggcatgctaacttccgagagcatggaacaatgctgccggcagtgccacaagtgtaa

SEQ ID NO: 66 - protein, 504 aa, Oceanobacillus iheyensis
MEEKLKRIQNKELGQKVVTAAEAASWIKDGMTLGLSGFTRAGDAKAVPTALVKRAEAGESLKVNVYTGASLGSNIDKLFAEAGIVNKRIPFQAEPSMRKAINAGEHLFVDQHLSHTSEMLRGDAMEAVDYAIIEAISVTENGYIIPSTSVGNSVAFAETADNIIIELNTAQPMELEGMHDIYGPGKQGDRDPIPLKEVDQRIGKVGIQVDTDKIKGIVFTHQPDSASTIVPPDEETQQIANHLLNFFREEIQAGRLTEKLMPLQSGIGSVANAVLHGMLDSEFKDLTVYSEVLQDAVFDLIDAGKVSFASACSITLSEDKMKHVFSNLAEYQSKLVLRPQEISNHPEIIRRLGLIAINTALEFDIYGNVNSTHVGGTKMMNGIGGSGDFARNARLGIFVTKSIAKNGDISSIVPYVSHTDHTEHDVDVIVTEQGYADLRGLAPRERVPQIIENCVHPLYKEALWEYYQEALERGGQTPHVLEKAFSWHANFREHGTMLPAVPQV

SEQ ID NO: 67 - DNA, 1524 bp, Corynebacterium efficiens
  CDS (1)..(1524)
atgtcagatcgcattgcttcggagaagctgcgttccaaggtcatgtctgccgatgaggcagcccagttcgtcaacgccggtgacaaggtcggtatgtccggcttcaccggtgcgggctaccccaaggccctgcccaccgccatcgccaaccgtgcgaaggaagcacacgcagcaggctccgagtacgcgattgatctgttcaccggcgcatccaccgcccccgactgcgatggtgtcctggccgaggccgacgccgtcaacttccgcatgccctacgcatccgacccgatcatgcgtaacaagatcaacgagggcaagatgttctactcggacatccacctctcccactccggccagtacgtggagaacggcttcttcggcaagctgaacgtcgccatcgtcgaggccacccgcatcaccgaggagggccacatcatcccgtcctcctccgtcggcaacaacgttgagtacctcaacgcagccgagaagatcatcatcgaggtcaactcctggcagtccgccgatcttgagggcatgcacgacatctggtccatgccgaagctgccgaaccgcatcgccatcccgatcaacaaggccggcgaccgcatcggtgccccctacatcgagatcgacaccgacaaggtcgtcgccgtggtggagaccaacaccccggaccgcaacgcaccgttcaagcccgtcgacgaggtctcccagaagatcgccggcaacttcctcgacttcctcgagggtgaggtccgcgcaggccgtctgtcctacgacggttatgtcatgcagtccggtgtgggcaacgtccccaacgccgtgatggctggcctgctggattccaagttcgagaacatccaggcctacaccgaggtcatccaggacggcatggtcgacctcatcgacgccggcaagatgaccgttgcctccgccacctccttctccctgtcccctgagtacgcggagaagatgaacaacgaggccaagcgttaccgcgagtccatcatcctgcgcccgcagcagatctccaaccacccggaggtcatccgccgtgtcgggctgatcgccaccaacggtctgatcgaggctgacatctacggcaacgtcaactccaccaacgtctccggctcccgcgtgatgaacggcatcggtggttccggtgacttcacccgcaacgcctacatctcctccttcatcaccccgtccgaggccaagggtggtgcgatttccgcgatcgttccattcgcctcccacatcgaccacaccgagcatgacgtcatggttgtcatctccgagtacggttatgccgacctgcgcggcctggcaccacgccagcgtgtggagaagatgatcgccctggctcacccggattaccgtccgctgctggaggagtactacgcccgcgccacctccggcgacaacaagttcatgcagaccccgcatgacctggccaccgcgttcgacttccaccgcaacctggccaagaacggttccatgaagaaccaggaccagatggtctag

SEQ ID NO: 68 - protein, 507 aa, Corynebacterium efficiens
MSDRIASEKLRSKVMSADEAAQFVNAGDKVGMSGFTGAGYPKALPTAIANRAKEAHAAGSEYAIDLFTGASTAPDCDGVLAEADAVNFRMPYASDPIMRNKINEGKMFYSDIHLSHSGQYVENGFFGKLNVAIVEATRITEEGHIIPSSSVGNNVEYLNAAEKIIIEVNSWQSADLEGMHDIWSMPKLPNRIAIPINKAGDRIGAPYIEIDTDKVVAVVETNTPDRNAPFKPVDEVSQKIAGNFLDFLEGEVRAGRLSYDGYVMQSGVGNVPNAVMAGLLDSKFENIQAYTEVIQDGMVDLIDAGKMTVASATSFSLSPEYAEKMNNEAKRYRESIILRPQQISNHPEVIRRVGLIATNGLIEADIYGNVNSTNVSGSRVMNGIGGSGDFTRNAYISSFITPSEAKGGAISAIVPFASHIDHTEHDVMVVISEYGYADLRGLAPRQRVEKMIALAHPDYRPLLEEYYARATSGDNKFMQTPHDLATAFDFHRNLAKNGSMKNQDQMV

SEQ ID NO: 69 - DNA, 1509 bp, Corynebacterium efficiens
  CDS (1)..(1509)
atgtctgagagaatcgcaagcgcagaattccgatcgaaggtaatgtccgccgaggaagccgcccagttcgtcaacaacggcgacaccgtgggcatgtccggattcaccggcgcggcctacccgaaggcgctgcccactgccatcgccaaccgcgccaaggaggcacactccaagggtgatgagtacgccatcaacctcctgaccggtgcctccaccgcaccggactgtgatggtgtcctggcagaggcggatgcgatcaactaccgcatgccgtaccagtccgatcccgagatgcgcaacaagatcaacgccggcgccatgaagtaccaggacatccacctgtcccactcgggcctgcaggtggagcagggtttcttcggtcatctggatgtcgccatcgtcgaggtctgccgcatcaccgaggacggccacctcgtgccatcctccggtgtgggcaacaacgtggagtacctggagtccgcccacaagatcatcatcgaggtcaactcctggcagtccctggagcttgagggcatggccgatatctaccgcgtcccccacctgcccaaccgcacccccatcccgatcaacaacgtcaatgaccgcatcggtgagaccttcatccgcatcgataccaacaaggtcgtcgccgtcgttgagaccgattcccccgaccgcaacagccccttcaagccgttcgacgagacctccaagcagatcgccggcaatttcctcgacttcctcgagggggaggtccgcgccggccgcctcacctacgacggttacatcatgcagtccggtgtgggtaacgtccccaacgccgtgatggccggtctgctcgactcgaagttcgagaacatcaaggcctacaccgaggtggtccaggatggcatgctcgacctcatcgatgccggcaagatgacccaggcctccgccacctccttcgcgctgtccccggagtacgcggagaagatgaaccgtgaggccagcacctaccgcaagagcctggtgctgcgcccactgcagatctccaacagccccgaggtcatccgccgcatgggtctgatcgcctccaacggcatgatcgaggccgatatctacggtaacgtcaactccacccacgtggccggtacccgcatcatgaacggcatcggcggttccggtgacttcacccgtaacgcgttcgtgtcctccttcatctccccgtcggtggccaagggggatgcgatctccgcggtcgttccgttcgcctcccacattgaccacaccgagcacgatgccatggtggtcatcaccgaatatggttacgccgacctgcgtggactggccccacgtgagcgtgcgccgaagatgatctccatcgcgcacccggattaccgtccgctgctggaggagtacttcgagcgtgcccagcagaacaagcaccagcacaccccgcacaacctgcgcgatgcgctgagcttccacatcaacctggatgagaccggttcgatgaagggcaacgcctaa

SEQ ID NO: 70 - protein, 502 aa, Corynebacterium efficiens
MSERIASAEFRSKVMSAEEAAQFVNNGDTVGMSGFTGAAYPKALPTAIANRAKEAHSKGDEYAINLLTGASTAPDCDGVLAEADAINYRMPYQSDPEMRNKINAGAMKYQDIHLSHSGLQVEQGFFGHLDVAIVEVCRITEDGHLVPSSGVGNNVEYLESAHKIIIEVNSWQSLELEGMADIYRVPHLPNRTPIPINNVNDRIGETFIRIDTNKVVAVVETDSPDRNSPFKPFDETSKQIAGNFLDFLEGEVRAGRLTYDGYIMQSGVGNVPNAVMAGLLDSKFENIKAYTEVVQDGMLDLIDAGKMTQASATSFALSPEYAEKMNREASTYRKSLVLRPLQISNSPEVIRRMGLIASNGMIEADIYGNVNSTHVAGTRIMNGIGGSGDFTRNAFVSSFISPSVAKGDAISAVVPFASHIDHTEHDAMVVITEYGYADLRGLAPRERAPKMISIAHPDYRPLLEEYFERAQQNKHQHTPHNLRDALSFHINLDETGSMKGNA

SEQ ID NO: 71 - DNA, 1515 bp, Xanthomonas campestris
  CDS (1)..(1515)
atgtccgacgaacgcatcctcaacgcgccgctgcgcgaccacctggtctctgccgaggccgctgctgcgctgatccagcccggcgagaccgtggcgatgagcggcttcaccgggtcgggttatcccaaggcagtgccgatggcgctggcgcagcgcatcgaagcggcgcacctgcagggcgaagcgttccagatcaagctgatgaccggcgcctccaccgcgcccgagctcgatggcgcgctggccaaggccgacggcatcgccatgcgcatgccgttccagtccgacccggatgcgcgccaacgcatcaatgccggcacgctggactacatcgatatccatctgagccacgttgcccagcacgtgtggttcggcttctacgggcagatcgacaccgcggtggtggaagtgtcggcgatccgcgccgatggcagcctggtgccgtccacctccatcggtaacaacaagacctggctggacctggccaggaaagtgatcatcgaggtcaacgactggcaaccggccggcctggatggcatgcacgatgtgtattacggcaccgcgctgccaccgcaccgcaaaccgattccgctgctgcacggcgacgaccgcatcggcgagcccagcctgcgctgcgacccggacaagatcgtggccgtggtgcgtacgcatggcccggaccgcaacagcccgtttgccgctgccgatgacagcagcgagcgcatcgccgaacacctgatcgccttcctgcgacacgaggtgagcaagggccggctgccggcgaacctgctgccgctgcaatcgggcgtgggcaatattcccaatgcggtgctggccggcctggcacgtagcggtttccgcgacctggaagccttcaccgaagtgatccaggacggcatgctggcgctgctgcgcgatggcgtcttgcgttatgcctcgtgcaccggttttgcgctcagcccggaaggcaacgaagaattcaagcgcaacatcgatttctaccggcagcgcatcgtgatgcgcacgcaggagatctccaaccatcccgagctggtgcggcggctgggctgcatcggcatgaacggcatgatcgaggccgacctgtacggcaacgtcaattccacccatgtcatgggcagccgcatcatgaacggcatcggcggctccggcgatttcgcgcgcaacgggttcctgtcgatcttcctcagccccagcatcgccaaggccggcagtatttcctcaatcgtgccgatggtcagccatgtcgaccacaccgaacacgacgtctcagtgatcgtgaccgaacaaggcctggccgacctgcgcggcctgacgcccaagcaacgtgcacgccagctgctagagcactgcgtgcatccgcgttaccgcgacgcgctggaagactacgtggcacgtgccaatcgcgacagctatggcaagcacacgccgcatctgctgaccgaagcattggcgtggcaccagcggtggctggagactggagatatgttggggtga

SEQ ID NO: 72 - protein, 504 aa, Xanthomonas campestris
MSDERILNAPLRDHLVSAEAAAALIQPGETVAMSGFTGSGYPKAVPMALAQRIEAAHLQGEAFQIKLMTGASTAPELDGALAKADGIAMRMPFQSDPDARQRINAGTLDYIDIHLSHVAQHVWFGFYGQIDTAVVEVSAIRADGSLVPSTSIGNNKTWLDLARKVIIEVNDWQPAGLDGMHDVYYGTALPPHRKPIPLLHGDDRIGEPSLRCDPDKIVAVVRTHGPDRNSPFAAADDSSERIAEHLIAFLRHEVSKGRLPANLLPLQSGVGNIPNAVLAGLARSGFRDLEAFTEVIQDGMLALLRDGVLRYASCTGFALSPEGNEEFKRNIDFYRQRIVMRTQEISNHPELVRRLGCIGMNGMIEADLYGNVNSTHVMGSRIMNGIGGSGDFARNGFLSIFLSPSIAKAGSISSIVPMVSHVDHTEHDVSVIVTEQGLADLRGLTPKQRARQLLEHCVHPRYRDALEDYVARANRDSYGKHTPHLLTEALAWHQRWLETGDMLG

SEQ ID NO: 73 - DNA, 1617 bp, Clostridium kluyveri
  CDS (1)..(1617)
atgagtaaagggataaagaattcacaattgaaaaaaaagaatgtaaaggctagtaatgtggcagaaaagattgaagagaaagttgaaaaaacagataaggttgttgaaaaggcagctgaggttactgaaaaacgaattagaaacttgaagcttcaggaaaaagttgtaacagcagatgtggcagctgatatgatagaaaacggtatgattgttgcaattagcggatttactccttccgggtatcctaaagaagtacctaaagcattgactaaaaaagttaatgccttagaggaagaattcaaggtaacactttatacaggttcatctacaggagccgatatagacggagaatgggcaaaagcaggaataatagaaagaagaattccatatcagacaaattctgatatgaggaaaaaaataaatgatggttctattaagtatgctgatatgcatttaagccatatggctcaatatattaattattctgtaattcctaaagtagatatagctataatagaggcagtagctattacagaagaaggggatattattccttcaacaggaattggaaatacagctacttttgtggaaaatgcagataaggtaatagtggaaattaatgaggctcaaccgcttgaattggaaggtatggcagatatatatacattaaaaaaccctccaagaagagagcccatacctatagttaatgcaggcaataggatagggaccacatatgtgacctgtggttctgaaaaaatatgcgctatagtgatgacaaatacccaggataaaacaagacctcttacagaagtgtctcctgtatctcaggctatatccgataatcttataggatttttaaataaagaggttgaagagggaaaattacctaagaacctgcttcctatacagtcaggagttggaagtgtagcaaatgcagttttggccggactttgtgaatcaaattttaaaaatttgagttgttatacagaagttatacaggattctatgctgaagcttataaaatgtggtaaagcagatgtggtgtcaggcacttccataagtccttcaccggagatgttgcctgagttcataaaggacataaatttctttagagaaaagatagtattaagaccacaggaaataagtaataatccagagatagcaagaagaataggagttatatccataaacactgctttggaagtagatatatatggtaatgtaaactccactcatgttatgggaagcaaaatgatgaatggtataggcggttctggagactttgccagaaatgcatatttgactatattcactacagagtctatcgccaaaaaaggagatatatcatctatagttcctatggtatcccatgtggatcatacagaacatgatgtaatggtaattgttacagaacagggagtagcagatttaagaggtctttctcctagggaaaaggccgtggctataatagaaaattgtgttcatcctgattacaaggatatgcttatggaatattttgaagaggcttgtaagtcatcaggtggaaatacaccacataatcttgaaaaagctctttcctggcatacaaaatttataaaaactggtagtatgaaataa

SEQ ID NO: 74 - protein, 538 aa, Clostridium kluyveri
MSKGIKNSQLKKKNVKASNVAEKIEEKVEKTDKVVEKAAEVTEKRIRNLKLQEKVVTADVAADMIENGMIVAISGFTPSGYPKEVPKALTKKVNALEEEFKVTLYTGSSTGADIDGEWAKAGIIERRIPYQTNSDMRKKINDGSIKYADMHLSHMAQYINYSVIPKVDIAIIEAVAITEEGDIIPSTGIGNTATFVENADKVIVEINEAQPLELEGMADIYTLKNPPRREPIPIVNAGNRIGTTYVTCGSEKICAIVMTNTQDKTRPLTEVSPVSQAISDNLIGFLNKEVEEGKLPKNLLPIQSGVGSVANAVLAGLCESNFKNLSCYTEVIQDSMLKLIKCGKADVVSGTSISPSPEMLPEFIKDINFFREKIVLRPQEISNNPEIARRIGVISINTALEVDIYGNVNSTHVMGSKMMNGIGGSGDFARNAYLTIFTTESIAKKGDISSIVPMVSHVDHTEHDVMVIVTEQGVADLRGLSPREKAVAIIENCVHPDYKDMLMEYFEEACKSSGGNTPHNLEKALSWHTKFIKTGSMK

SEQ ID NO: 75 - DNA, 1563 bp, Geobacter sulfurreducens
  CDS (1)..(1563)
atgtcggaattgcacagaagaatcaggaagacgaatctccatgagcggatcaggacggtagaagaggtcatccccctcttccaggacggcatgaacctgggctggtcgggcttcacccccgccggctaccccaaggcggtacccatcgccctggcggaccatgtggagaagaacgggctgcaggggaagctgcgcttcaacctcttcatcggcgcctccgtgggcgtcgagacggaagaccgctgggcctccctggacatgatcgaccgccgctggccctaccagaccggcaagaacatccaggccggcatcaactccggccgcatccgcatgggtgaccgccacctctcaatgttcgcccaggatttggggtacggcttctacaccaaggagaacggcggccggctggatctggccatcatcgagtgctccgccatcaccgagaacggcggtctggtgctgaccgcctcctgcggcgccgtccccgagatcgtccagatcgccgacaagatcatcatcgagatcaacaccgccatccccaactatgaaggcctgcacgacatcatcgaacccgtcagccctcccaaccggctcccctacctcatcagccgggtggatgaccgggccggatctccctacgtccgcgtcgataccgacaagatcgtcgccatcgtcgagtccacccatccggacaacggccgcgcttttgccgagcaggacgacacctccgaggccattgccaacaatatcctggacttcttccaggcagaggtgaaggcgggacgcctccccaagaacctgctgccgctccagtccggcgtcggctccatcgccaacgccgttatcggcggtctggccaagggccccttctccggcctgagggtctggaccgaggtactgcaggacaccatgcttgacctcttcgactccggcaagctcgatttcgcctccaccgtctccctctccttctccgtggacggcttcaagcgcttctacggcgactgggacaagtacagcgacaaggtcatcatgcgccccctctccatcgccaaccacccggagcccatccggcgcctgggatgcattgccatgaacactcccgtggagttcgacatctacgcccacgccaactccaccctggtcggcggcacgcgcatgatcaacggcatcggcggctccggcgatttcctgcgcaacgcctacctctccatcatgcacaccccgtcggcccgccccaccaagaccgaccccaccggcatcacctgcgtcgtgccccacgtcccgcacgttgaccataccgagcacgaccttgacgtgctggtcaccgagcagggcctagccgacctgcggggcctggcccccaaggaccgcgcccgcgagatcatcgccaagtgcgcccacccggactacaagcccctcctcaccgagtacctggagatggccaccagggactgcatggcccgcaaggcggggcatgagccccagttgctggaccgggtgttcaagatgcaggtgaacctggccaagaacggaacaatgaagatcgacaactgggatatctag

SEQ ID NO: 76 - protein, 520 aa, Geobacter sulfurreducens
MSELHRRIRKTNLHERIRTVEEVIPLFQDGMNLGWSGFTPAGYPKAVPIALADHVEKNGLQGKLRFNLFIGASVGVETEDRWASLDMIDRRWPYQTGKNIQAGINSGRIRMGDRHLSMFAQDLGYGFYTKENGGRLDLAIIECSAITENGGLVLTASCGAVPEIVQIADKIIIEINTAIPNYEGLHDIIEPVSPPNRLPYLISRVDDRAGSPYVRVDTDKIVAIVESTHPDNGRAFAEQDDTSEAIANNILDFFQAEVKAGRLPKNLLPLQSGVGSIANAVIGGLAKGPFSGLRVWTEVLQDTMLDLFDSGKLDFASTVSLSFSVDGFKRFYGDWDKYSDKVIMRPLSIANHPEPIRRLGCIAMNTPVEFDIYAHANSTLVGGTRMINGIGGSGDFLRNAYLSIMHTPSARPTKTDPTGITCVVPHVPHVDHTEHDLDVLVTEQGLADLRGLAPKDRAREIIAKCAHPDYKPLLTEYLEMATRDCMARKAGHEPQLLDRVFKMQVNLAKNGTMKIDNWDI

SEQ ID NO: 77 - DNA, 1596 bp, Geobacter sulfurreducens
  CDS (1)..(1596)
atgtcagagtacggcacactgcaggaccgcgtacgttgcaagtcactgctcaacaaggttatgtcggccgaggagactatccagttcttcaagccgggcatgaaccttggctggtccggcttcaccccggcaggttatcctaaggcagtgcccatcgcactggcagatcacgttgagaagaacagcctgcagggcaagatgaagttcaacctcttcatcggcgcctccgtcggggccgaaaccgaagaccgctgggccactctcgacatgatcgaccgtcgctggccgtatcagaccggtaagaacatcgccgccggcatcaacgagggccgcatccggatgggtgacaagcacctctccctctttgcccaggatctgggctacggcttctacaccaaggacagcgaaaccggcaagcttgacctcgccatcatcgaggtttccgccatcaccgaagacggcggactggtccccaccacctcttgcggcgttattcccgagatcctcatgatctgcgacaagatcatcgtggaagtgaacaccggtcagccctccttcgaggggatgcacgacatcgtcgtctgcaaccaccccccgaagcgccagattctgggcatcacccatgccggtgagcggatcggtacaacctacgtaccgtgcgacccgagcaagatcatcgccgtggttgagtccaagtaccgtgacaaggggcgtgccttctccgagcaggacgacacctccgaggccattgccaacaacatcatcgacttcttcagccatgaagtaaagatgggtcgtctgcccaagaacctgcttccgctccagtcaggcgtcggttccatcgccaacgctgtaatcggcggcctggccaagggtcctttctccaacctgaccgtttacaccgaagttctccaggacaccatgctcgacctgttcgattcgggcaagctggatgccgcttcctcctgctccctctctctctccgagaccccgggcttcccccgtttcttcgagaactgggagaagtacttcgacaagatcaccctgcgtccgctctccatctccaacgcaccggagccgatccgccgtctcgggtgcatcgccatgaacaccccggtcgagatcgacatctatgcccacgccaactccacgctggtcggcggcacacggatgatcaacggcctcggcggttccggcgacttccttcgcaacggcttcttgaagatcatgcacactccgtcgagccgtccatccaagaccgacccgaccggtatctcctgcgtggtgccgcactgctcccacatcgaccacaccgagcacgatctggactgcgtggtcaccgagcagggtctggccgacctccgtggtctggcaccgaaggatcgcgcaaagcggattatcgagaagtgcgcccacccggactacaagccgattctcagcgagtacttggcaatcgccagtgccgattgcctcaagcgcaaggtgggccacgagccgcaactgtgggaccgcgccttcaagatgcacctcaacctggagcgcaacggcaccatgaagatcaagaactgggacgtgaaggtcgatctctgcgagtaa

SEQ ID NO: 78 - protein, 531 aa, Geobacter sulfurreducens
MSEYGTLQDRVRCKSLLNKVMSAEETIQFFKPGMNLGWSGFTPAGYPKAVPIALADHVEKNSLQGKMKFNLFIGASVGAETEDRWATLDMIDRRWPYQTGKNIAAGINEGRIRMGDKHLSLFAQDLGYGFYTKDSETGKLDLAIIEVSAITEDGGLVPTTSCGVIPEILMICDKIIVEVNTGQPSFEGMHDIVVCNHPPKRQILGITHAGERIGTTYVPCDPSKIIAVVESKYRDKGRAFSEQDDTSEAIANNIIDFFSHEVKMGRLPKNLLPLQSGVGSIANAVIGGLAKGPFSNLTVYTEVLQDTMLDLFDSGKLDAASSCSLSLSETPGFPRFFENWEKYFDKITLRPLSISNAPEPIRRLGCIAMNTPVEIDIYAHANSTLVGGTRMINGLGGSGDFLRNGFLKIMHTPSSRPSKTDPTGISCVVPHCSHIDHTEHDLDCVVTEQGLADLRGLAPKDRAKRIIEKCAHPDYKPILSEYLAIASADCLKRKVGHEPQLWDRAFKMHLNLERNGTMKIKNWDVKVDLCE

SEQ ID NO: 79 - DNA, 1515 bp, Bacillus cereus
  CDS (1)..(1515)
atggagaataatttggatagaattagggatgaacgtctgaaagatcgcgtagttacacctgaagaagcagcttcatggattgaaagtggaatgactttaggcttaagtgggtttacacgtgcaggtgatgtaaaagcagtcccatttgcgcttgtaaaccgagttaagaatgatacatcttttaaagtaaatgtttacactggtgcctctttaggttctgatgtagataaattatttgcggaagcaggaattttagggaaaagattgcctttccaagctgatgcgactatgcgaaaaggaattaataacggagattttttatttgtggaccagcacttatctcatacagcagagttacttcgcgctgatgttatggatgtagattttgctattttggaagcggttgcaattactgaagatggcatgattattccgacaacttcaataggaaattctttagcgttttctttaaatgctaagtccattattattgaaatgaatatggctcaatccacgcagttagaaggactgcatgatttatatgaaccaggtaagcaaggagaaagacttccaattccgattgtgaaaacggatgatcgaattggaacgattggcattccaatcgatgttgaaaaggtgaaagggattgtgtttacgaaccaattagactcaccctcgacaattgttcctccggatgaagaaactgttattatggcacagcatttaatagagttccttcgaaaagaagtcgaagtaggtcgattaacaaatcgtttagcgccgctacaatcaggaattggctcagtggctaatgcagttcttcatggaatgttagattcggagtttgaagatttagaagtgtattctgaagttttacaagatgcggtctttgatcttatggatgctggaaaagtcaatttcgcttcatgctgctcaatcacactttctgaggagaaaatgcaaaaagtattttccaactttgaaaaatatcgtgacaaattaatgatgcgcccgcaagagatttctaatcatcctgaaatcattcgtcgcctcggattaatctcgattaatactgctttagaattagatatatacggaaatgtgaactctactcacgttttaggcacaaaaatgatgaacggtattggtggttctggtgattttgcgagaaatgctcgcctagctatctttgttacgaaatcgattgcgaaaggtggtaacatttcaagtatcgttccttttgtttcacatgtggaccatacggaacacgatgtagatgttatcgtcactgaacaagggtatgttgatctaagaggacttgccccaagagaaagagtggaattaattatagagaattgcgcacatccaatgtatcgtgatcagctaagagcttattacgaagaagctaaaacgagaggtggacaaactcctcatgttttagaaaaagctttttcttggcatacgaattatgctaaaaatggaacaatgcttgaagcggtagtagaaactgtatag

SEQ ID NO: 80 - protein, 504 aa, Bacillus cereus
MENNLDRIRDERLKDRVVTPEEAASWIESGMTLGLSGFTRAGDVKAVPFALVNRVKNDTSFKVNVYTGASLGSDVDKLFAEAGILGKRLPFQADATMRKGINNGDFLFVDQHLSHTAELLRADVMDVDFAILEAVAITEDGMIIPTTSIGNSLAFSLNAKSIIIEMNMAQSTQLEGLHDLYEPGKQGERLPIPIVKTDDRIGTIGIPIDVEKVKGIVFTNQLDSPSTIVPPDEETVIMAQHLIEFLRKEVEVGRLTNRLAPLQSGIGSVANAVLHGMLDSEFEDLEVYSEVLQDAVFDLMDAGKVNFASCCSITLSEEKMQKVFSNFEKYRDKLMMRPQEISNHPEIIRRLGLISINTALELDIYGNVNSTHVLGTKMMNGIGGSGDFARNARLAIFVTKSIAKGGNISSIVPFVSHVDHTEHDVDVIVTEQGYVDLRGLAPRERVELIIENCAHPMYRDQLRAYYEEAKTRGGQTPHVLEKAFSWHTNYAKNGTMLEAVVETV

SEQ ID NO: 81 - DNA, 2577 bp, Saccharomyces cerevisiae
  CDS (1)..(2577)
atgtcgtccttatccacttcatttgattcatcgtcagatttaccaaggtcaaaatccgttgacaatacggcggcttccatgaagacaggcaagtacccaaaattagagaactataggcagtattctgatgcacaaccaatacgtcacgaagcgcttgcattgaaagtggacgaaacgaaagattctagacacaaatttagttcctctaacggggagaatagtggagtggaaaatggaggctatgtggagaaaacgaatatatccacaagtggccgcatggattttgaaggtgaagcagaagcagaagcagtgaaacgttaccagttaagatctttcgcgcttttaagttctaatgcgaggccatccaggctagcaaagtctgaaactcaccaaaagcagattcatgtagagagcatcgctccctctttgccaaagaatgcggctttagagagaggccatgatacggcgttacctgccggtacgtcaagtaacagatgcaacttagaagcctcctcctcggcaagaacttttacaagcgctcgtaaggcttcgctagttagcgcaatctttgaaacatcggctgaatcagagcatggtacgcatcccaaacaggcgaaacttaagagaagaacctattctacaatatcgacacattcatcagtcaatcctacaacgttgttgacaagaactgcatcgcaaaagtccgatatgggaaatgacacacgaagaattaaaccgttacgtatggatagcagggtatctttccatagtgagatatcgcaagcatccagggattctcaagaaacagaagaagacgtttgttttccaatgtttcgactattacatacaagagttaatggtgttgattttgatgagttggaagaatatgcccagatttcaaatgctgaaagaaatctgtctttggcgaaccatcaaaggcacagtgaacgaacatacaatcataccgaccaagatactggatttactaactctgcttccacttcaggatcctcagcagctctgaaatatacacctgaaatttcacggactcttgaaaaaaattgcagcgttaatgagatgtacgtatctgaaaacaatgaatctgtgagggaagatgataaacctgatctacaccctgacgtaacatttggtagaaataagattgaaggtgaaaaagaaggaaatgattcgagttatagccgggcgtattataccctccaaaatacagaatatcaaattcctagtagattttcgttcttccgctctgaatctgatgaaactgtgcatgctagtgatatcccttctttgatatccgagggacagacgttttatgagttattcaagggaggcgatccaacgtggtggttggattgcagttgtccaactgatgatgaaatgcgttgcatagcaaaaacatttggaatccatcctttgaccgcggaagatatcaggatgcaagaaacgcgtgaaaaggtagagcttttcaaatcctattactttgtctgtttccatacatttgaaaatgataaagaatcggagaattatcttgaacctataaatgtttacatcgttgtttttaggtcaggtgtcttgacttttcattttgacccaatatcacactgtgccaatgtaagaagacgtgtaagacaattacgtgactatgtcagtgtcaattcagattggttatgttatgctttaatcgatgatatcacagatagttttgctccggttattcaatccatcgagtatgaagctgattcgattgatgattcagtgtttatgacccgtgatatggattttgcagccatgttacaaaggattggtgaaagtaggcgtaagacaatgacgctgatgagactcttgagcggtaaagcagatgttatcaaaatgttcgccaaaagatgtcaagatgaaactaatggtattgggccagtgcttaaatctcaaactaacatggtgaacttacaagcggaacaagagaatgtgaaccagaataatagtaataaccaaataagcttatcaaatagctatatgcaaacaacatcacaaccaaggggagatattgctttatacttaggtgatattcaggatcatttgttgacgatgtttcaaaatttattggcgtacgaaaagattttttctagatcacatgcaaactacctggcccaattacaagtggaatcatttaactctaataataaagttacagaaatgttgggtaaagttactatgttaggtacaatgttagttccattaaatgttattactggtctgttcggtatgaatgtaaaagttccaggaagaaatggaagtattgcgtggtggtatggaattttgggggtactgcttttactagctgtcataagctggtttttagctagctattggatcaaaaaaatagacccacctgcaacgctcaacgaagccgcaggtagtggggccaaatcagtcatatctagttttttaccgaaaagagataaaagatttaacgatgattctaaaaatggcaatgcgagagttggcgttcgaaggaaatcaactgtcagtctacccagtagatatagccgttacaattaa

SEQ ID NO: 82 - protein, 858 aa, Saccharomyces cerevisiae
MSSLSTSFDSSSDLPRSKSVDNTAASMKTGKYPKLENYRQYSDAQPIRHEALALKVDETKDSRHKFSSSNGENSGVENGGYVEKTNISTSGRMDFEGEAEAEAVKRYQLRSFALLSSNARPSRLAKSETHQKQIHVESIAPSLPKNAALERGHDTALPAGTSSNRCNLEASSSARTFTSARKASLVSAIFETSAESEHGTHPKQAKLKRRTYSTISTHSSVNPTTLLTRTASQKSDMGNDTRRIKPLRMDSRVSFHSEISQASRDSQETEEDVCFPMFRLLHTRVNGVDFDELEEYAQISNAERNLSLANHQRHSERTYNHTDQDTGFTNSASTSGSSAALKYTPEISRTLEKNCSVNEMYVSENNESVREDDKPDLHPDVTFGRNKIEGEKEGNDSSYSRAYYTLQNTEYQIPSRFSFFRSESDETVHASDIPSLISEGQTFYELFKGGDPTWWLDCSCPTDDEMRCIAKTFGIHPLTAEDIRMQETREKVELFKSYYFVCFHTFENDKESENYLEPINVYIVVFRSGVLTFHFDPISHCANVRRRVRQLRDYVSVNSDWLCYALIDDITDSFAPVIQSIEYEADSIDDSVFMTRDMDFAAMLQRIGESRRKTMTLMRLLSGKADVIKMFAKRCQDETNGIGPVLKSQTNMVNLQAEQENVNQNNSNNQISLSNSYMQTTSQPRGDIALYLGDIQDHLLTMFQNLLAYEKIFSRSHANYLAQLQVESFNSNNKVTEMLGKVTMLGTMLVPLNVITGLFGMNVKVPGRNGSIAWWYGILGVLLLLAVISWFLASYWIKKIDPPATLNEAAGSGAKSVISSFLPKRDKRFNDDSKNGNARVGVRRKSTVSLPSRYSRYN

SEQ ID NO: 83 - DNA, 25 bp, Primer
atgtcgtccttatccacttcatttg

SEQ ID NO: 84 - DNA, 26 bp, Primer
ttaattgtaacggctatatctactgg

SEQ ID NO: 85 - DNA, 954 bp, Methanococcus jannaschii
  CDS (1)..(954)
atgattacggtaattgctatagctaaagatggcagtattgtcgagccaaaacttgatgaaattagctttgaagattatagacttatttggattgattgttatgacccaaaagatgaagagctatataaactctctaaaaaaattggtatttctgtctctgatttacaaattggtttagatgagcaggaaattccaagggtagaggaagatgaggacttttacttaattatttacaaagctccattatttgaagaggatattacaacaacatccttaggtatctatattaagaataacctcctactaacaatccactcggataaaataaaggctattggaagattgcataaattaatatcaacaaaaaaaccaagaattgtatttgaaagaggaattggctttttattataccatatattaaatgagattacaaggagttattcaagaattttaatgaatttagaagatgagttggaggagttggaggataaattattagctggctatgacagagaggttatggaaaaaattttaggattaagaaaaactttggtttattttcataaatctttaatagctaatagggatgtcttagttttattaaagagaaagtatcttccaataaccacaaaagaagacagagagaactttgaagacctttactacgacactttacagttaattgatatgtcagcaacctatagagaggttttaacctcaatgatggatataaccctctcattagaaaatataaagatgaaccaaattatgaaaatcctaactatggttacgacaattttcgctgttcccatgtggattactggaatatacgggatgaacttctcttatttacctttagcaaacaaccctcaaggtttttggcttgtaatggctttgatggttgtaataattatgatatttgtctatatatttagaaggtcaggatggatttaa

SEQ ID NO: 86 - protein, 317 aa, Methanococcus jannaschii
MITVIAIAKDGSIVEPKLDEISFEDYRLIWIDCYDPKDEELYKLSKKIGISVSDLQIGLDEQEIPRVEEDEDFYLIIYKAPLFEEDITTTSLGIYIKNNLLLTIHSDKIKAIGRLHKLISTKKPRIVFERGIGFLLYHILNEITRSYSRILMNLEDELEELEDKLLAGYDREVMEKILGLRKTLVYFHKSLIANRDVLVLLKRKYLPITTKEDRENFEDLYYDTLQLIDMSATYREVLTSMMDITLSLENIKMNQIMKILTMVTTIFAVPMWITGIYGMNFSYLPLANNPQGFWLVMALMVVIIMIFVYIFRRSGWI

SEQ ID NO: 87 - DNA, 1164 bp, Synechocystis sp.
  CDS (1)..(1164)
atgccccaaacccaacccggcattgaggattttctcctgcgccaactgcgtcatccccaagaagaagaggaagaagaagattattttgactacttctatgacgagccgggtagtgaaccgggtaccctcagcattgaacccgatgcgcccccttcccgcattgtgttggtggattatagccccagccatgccgtgcgaaagtcggatattagtcccaatgccctgagaccttatttaggtacaaatactgtttcttggatggatattgaaggtttaggcagtgaagaagtgcttaaggaagtgggggaaatttttaaattacaccccctacttttagaagatattgttaacgtcccccagcgagcaaaggtagaagattataacgaccatgtgatggttattgcccatcgggtgcgtcctaatcgggaagaagatggctttgaaagtgagcaggttagttttgtgttgggcaaacgttacctattaactttccaggaagggcacattattgattgttttaatcccctaagggaaagaattcgcaccaatcaaggtaaagtttgccaacaaggagcggattatctttgctatttgttaattgatatgttaattgatgaatattttcccctcttggaagattatgaagaacgcattgaagccctagaagacaccattattcgtaatcccaacagctcattaatggaggaaatttaccatattcgccgggaacttttagccctgagaaggttgatttggcccctgcgccatgtgatgaatgtgctgctgcgggacaccaccaattccatcgtaacagcagacgtaagaatttactttcgagattgctacgatcacattattcaggtgttagatattatcgaagcttaccgggaattagcttctagtttaatggaggtttatatgactgccatgagcaataaaatgaatgaagtaatgaaatttttgaccgtcatttctaccatttttattcccctaacttttattgccggggtttacggtatgaacttcaaagaaatgccagaactaaacagccgctggggctactatattacttggatagtgatgctcttaattgccggaggatccctctatttcttctggcgtaagggctggcttagtccctcctatgatttgggagaaaagtaa

SEQ ID NO: 88 - protein, 387 aa, Synechocystis sp.
MPQTQPGIEDFLLRQLRHPQEEEEEEDYFDYFYDEPGSEPGTLSIEPDAPPSRIVLVDYSPSHAVRKSDISPNALRPYLGTNTVSWMDIEGLGSEEVLKEVGEIFKLHPLLLEDIVNVPQRAKVEDYNDHVMVIAHRVRPNREEDGFESEQVSFVLGKRYLLTFQEGHIIDCFNPLRERIRTNQGKVCQQGADYLCYLLIDMLIDEYFPLLEDYEERIEALEDTIIRNPNSSLMEEIYHIRRELLALRRLIWPLRHVMNVLLRDTTNSIVTADVRIYFRDCYDHIIQVLDIIEAYRELASSLMEVYMTAMSNKMNEVMKFLTVISTIFIPLTFIAGVYGMNFKEMPELNSRWGYYITWIVMLLIAGGSLYFFWRKGWLSPSYDLGEK

SEQ ID NO: 89 - DNA, 1143 bp, Synechocystis sp.
  CDS (1)..(1143)
atgcccaacaagcctcagtttcgacaatctaatcttgtttcccatttcaattattttaattcaccagaaagtattcctggaacattaaatctttcccccaatgcccctccaccgagaataattttaattgattacaataaaaatcaagccacaaaaatagagttaaaaaatcccctggattgtgaagcttatgttgatactgaatccgtatcctggattaacattgacggcttggggaatcacacaacttgggaacaattaggtgaggtatttaaacttcatcctgttgctttagaggatattgttaacgtcccccaacgtccgaaagtagttgaatatgaaaaccatttaatttttatttctcggatggtaaccctggatcaatcatctcaaacttttatcagtgaacaaattagttttattttgggtaaacattatttgttgaccatccaagaagaaccaaaatatgattgtttattttccgttagggaaagaattcgcactaaaaaaggggcaattcgacaaaagaatgctgattatttattttatgctttaattgatgctattatcgatggcttttttcctgtgatggaagtctatggtgaactagttcaatctttacaaagtgagattatttcttgtccaacgaataaatcattggccaagattcatcaattacaacaggatttattaattatgagacgggctatttggccccaacgggatgcaattaattctttacttcgggatggcagtgatttaatttctgatgaggtgcgagtatttttacgggattgttatgaccacacaattcaaatcttggatatgatagaaacttatcgagatttagcatctaacctaacagatatttatctttcctctgttagtaatcgaatgaatgaaattatgaaaacactaacagtaatttctagtatctttattccgctaacttttattgctgggatctatggtatgaattttaatcctgataaatctccttggaatatgccagagttaaactggtattgggggtatcctgtgatttggatggtaatgttgacagtgggagggatgatgctttattttttttggcgtaagggttggtttagaaatcttaatgatgttgaaaaaggaaatagataa

SEQ ID NO: 90 - protein, 380 aa, Synechocystis sp.
MPNKPQFRQSNLVSHFNYFNSPESIPGTLNLSPNAPPPRIILIDYNKNQATKIELKNPLDCEAYVDTESVSWINIDGLGNHTTWEQLGEVFKLHPVALEDIVNVPQRPKVVEYENHLIFISRMVTLDQSSQTFISEQISFILGKHYLLTIQEEPKYDCLFSVRERIRTKKGAIRQKNADYLFYALIDAIIDGFFPVMEVYGELVQSLQSEIISCPTNKSLAKIHQLQQDLLIMRRAIWPQRDAINSLLRDGSDLISDEVRVFLRDCYDHTIQILDMIETYRDLASNLTDIYLSSVSNRMNEIMKTLTVISSIFIPLTFIAGIYGMNFNPDKSPWNMPELNWYWGYPVIWMVMLTVGGMMLYFFWRKGWFRNLNDVEKGNR

SEQ ID NO: 91 - DNA, 960 bp, Bacillus subtilis
  CDS (1)..(960)
atgatcaacattaccgcaatcacaacagagcatcagctgctgaaaaatataccgatcgaacgagtggaacagcctgatattgcatggtactgggttgatttttacggcccggaggatacggaaacggcgttattgagagatttttttcattttcacccgcttgccattgaggattgcttccagcatatgcagcggccaaagcttgaccattatgacggctatcgtttttacgtgattcatgcgctgaataaggaaacacttgagacggaggaagtcgatatctttcaaggcgaaaaatttgtcgtcacctttcatttacacgaaacgcccggtatcgctaaagtccgggagcgtttgtatgcttcaccggacatattgaaaaaagggcccgggcatatttcttatatgatcatggatcagcttgttgatgaatattttcctctcgtgtataaaattgaagaccggctgaatgaaattgaagaaagccgtccccacaaaacgtatggaacgctgatgaacgaggtgtttgatctcagaacagacctattgcatttgagacggacgattatcccgatgcgtgatttgctctaccggattttaagccttgaccatgtgaaagagcagcgggaaacgaaagcctatttcagcgacatatatgatcatttgttaaagttgtctgaaattgtggaatccaaccgtgacatgacgtccgacttgcgtgacagctacgtgacgctaaactcaaaccggatgaatgcgattatgatgacactgacgatcgtatcaaccattttcatcccgctcacctttattgccggtgtatacggtatgaacttcgactttatgccggagctgcattggaaatacggatatttcgctgtacttggcctgatggccgcgcttgtgattggaatgctgatttggtttgtacataaaggatggttcaatatttttaaataa

SEQ ID NO: 92 - protein, 319 aa, Bacillus subtilis
MINITAITTEHQLLKNIPIERVEQPDIAWYWVDFYGPEDTETALLRDFFHFHPLAIEDCFQHMQRPKLDHYDGYRFYVIHALNKETLETEEVDIFQGEKFVVTFHLHETPGIAKVRERLYASPDILKKGPGHISYMIMDQLVDEYFPLVYKIEDRLNEIEESRPHKTYGTLMNEVFDLRTDLLHLRRTIIPMRDLLYRILSLDHVKEQRETKAYFSDIYDHLLKLSEIVESNRDMTSDLRDSYVTLNSNRMNAIMMTLTIVSTIFIPLTFIAGVYGMNFDFMPELHWKYGYFAVLGLMAALVIGMLIWFVHKGWFNIFK

SEQ ID NO: 93 - DNA, 1056 bp, Archaeoglobus fulgidus
  CDS (1)..(1056)
atgcggattccagcgacaatcaaaaagaagatggcccttccacccgcaactcccgtcttcaccggcgaaaagaaagttgaggaaactaaaattactgcggcaatttacgacgagaaatcggtggagtttaaggagctagaggtgggggagcttgaaagtgtggtcagaagcgcgctcgcactcaataaaaagctctggattgatgtcgttggtgttcacgatgaaagtcttatcgctaaaatctgcgaattcctgggaatccaccctctcgctgctgaggacattctcaacacagcccagagggtaaaaattgaagactacgacgaccacctttttcttgtacttaaaattctgctttacaacgagacccttgaaattgaccagctcagcctggttttgaagaaaaaccttgtggcgacgtttgaagaaagagagtactggattctcgactccatccgctcaaggcttaagtccggggggagaatgagaaagctcgctggcgattatcttgcctataccatactcgacgcggttgttgacagctacttcgaagcacttctgaaaatttcggatgagattgaggtgttggaggatgaggttgtttctggggacagcacactcatcgggaagattcacagcctgaagagggaaatacttgccttcagaaacgccgtatggcccctaagagatgttctcagcttctttaccagagttgagcacgagcttataggtgaggaggtaaaggtgtattacagggacgtttacgaccacgctgttcgactcatggaggttcttgagacgcagagagagctgctggtgagcttgagagacttatttctgtcagcggtcagcaacaagctcaacgagataatgaaggtgctcactatgattgcgaccatattcattcccctgagcttcattgcgggtgtttatgggatgaattttaagtacatgcctgagctggagtggaagtacgggtatccggccgttctgacagttatggccgtcatcgcactggtaatgattgccttcttcaggaggaaggggtggttataa

SEQ ID NO: 94 - protein, 351 aa, Archaeoglobus fulgidus
MRIPATIKKKMALPPATPVFTGEKKVEETKITAAIYDEKSVEFKELEVGELESVVRSALALNKKLWIDVVGVHDESLIAKICEFLGIHPLAAEDILNTAQRVKIEDYDDHLFLVLKILLYNETLEIDQLSLVLKKNLVATFEEREYWILDSIRSRLKSGGRMRKLAGDYLAYTILDAVVDSYFEALLKISDEIEVLEDEVVSGDSTLIGKIHSLKREILAFRNAVWPLRDVLSFFTRVEHELIGEEVKVYYRDVYDHAVRLMEVLETQRELLVSLRDLFLSAVSNKLNEIMKVLTMIATIFIPLSFIAGVYGMNFKYMPELEWKYGYPAVLTVMAVIALVMIAFFRRKGWL

SEQ ID NO: 95 - DNA, 1056 bp, Thermotoga maritima
  CDS (1)..(1056)
atggaggaaaagaggctgtctgctaagaaaggtctccccccaggaacgctcgtttacacagggaagtacagggaagattttgagattgaagtgatgaattactccatagaggaatttcgcgagttcaaaaccacagatgtcgaatccgttcttcccttcagagattcttcaacacccacctggataaacataacaggcatacacaggacggatgtggttcaaagggtaggtgagttctttggtattcatcctctcgtgctcgaagacatcctcaatgtgcatcagagaccaaaagtggagtttttcgaaaactacgtgttcatcgttctgaagatgttcacctatgataaaaatcttcatgaactggaatcggagcaggtcagtttgatactcacaaaaaactgcgttcttatgtttcaggaaaagataggggacgtgttcgatcccgtacgggaaagaatcagatacaacaggggaatcataaggaaaaagagagcggattacctcctctactcactgatagatgcactggtggatgactatttcgtcctgctggagaagatcgacgatgagatcgatgtactggaggaagaagtgctcgaaagacctgaaaaagagacagttcagaggacacatcaactcaagagaaatctggttgaactgagaaagacgatctggccgttgagagaagtgttgagttctctttacagagatgttcctcctcttatagaaaaagaaacggtcccatatttcagagatgtatacgatcacactatccagattgcagacaccgtagaaaccttcagagacatcgtgagcggtcttcttgatgtgtatctttcgagtgtaagtaacaaaacaaacgaagtgatgaaggtgctcaccatcatagcgacgatcttcatgcctctcaccttcatagcgggtatctacggaatgaacttcgaatacatgccggagctcagatggaaatggggctatcctgtggttctcgctgttatgggtgtgatcgctgtcatcatggtggtctacttcaagaaaaagaagtggctgtaa

SEQ ID NO: 96 - protein, 351 aa, Thermotoga maritima
MEEKRLSAKKGLPPGTLVYTGKYREDFEIEVMNYSIEEFREFKTTDVESVLPFRDSSTPTWINITGIHRTDVVQRVGEFFGIHPLVLEDILNVHQRPKVEFFENYVFIVLKMFTYDKNLHELESEQVSLILTKNCVLMFQEKIGDVFDPVRERIRYNRGIIRKKRADYLLYSLIDALVDDYFVLLEKIDDEIDVLEEEVLERPEKETVQRTHQLKRNLVELRKTIWPLREVLSSLYRDVPPLIEKETVPYFRDVYDHTIQIADTVETFRDIVSGLLDVYLSSVSNKTNEVMKVLTIIATIFMPLTFIAGIYGMNFEYMPELRWKWGYPVVLAVMGVIAVIMVVYFKKKKWL

SEQ ID NO: 97 - DNA, 1122 bp, Mycobacterium leprae
  CDS (1)..(1122)
atgggggttgagatgttcccggggtttgacccgttacctgaagcgctgaggccggtcacgaagccccgactgtacacgcctcacgtacatcccattttccccccgctcaccgagcccttggtcgactgcggcgtctatgtcggaggccatcggctacccgacaaatacacaacgtacaccgccgcgctgagcagggtgcgcgagatcgaactgatggggaacgagggattcgtctggatcgggttacacgagcctgaagcaagccacatgcataacgtcgccgacgttttcgggctacaccccttggcagtcgaggacgccgtgcacgcccatcagcggcccaagttggaacgctacgacgacacgttgtttctggtcctcaagaccgtcaattatgtaccgcacgaatcggtggtgctggcccgccagatcgtcgaaaccggcgaggtgatgatcttcgtcggcaagaatttcgtggtcacggtccgccacggcgagcatggtgagctgtccgaggtgcgtaagcgaatggataccgaccccgagcatctgcggctgggctcgtacgctgtgatgcatgccatctcggactacgtggtagaccgctatttagcggtgaccaatctgatggaaggcgatatcgacgccatcgaggaagtggcgtttgctcccggccgcaagctcaacgtcgagccgatttacctactcaagcgcgaggtcatcgaacttcgccgctgtgttgccccgctctccgccgcactccagcgaatgcaaacggataacaaagacttaatctccaaagaattgcgccgctacctgcgtgacgtagctgaccaccagaccgaggccgcagatcaaatagccagctatgacgacatgctcaattcactagtacaggccgcattggctcgtgtcgggatgcagcagaacaacgatatgcgcaagatggcggcctgggccggcatcgtggcgatgcccactatggtcgccgccatctacggtatgaacttccgtttcatgcccgagctgaactggacgtggagttacccgctggtaatggccggaatgaccattgtctgcctggttctttactggcaattccgaaacaggaactggctgtaa

SEQ ID NO: 98 - protein, 373 aa, Mycobacterium leprae
MGVEMFPGFDPLPEALRPVTKPRLYTPHVHPIFPPLTEPLVDCGVYVGGHRLPDKYTTYTAALSRVREIELMGNEGFVWIGLHEPEASHMHNVADVFGLHPLAVEDAVHAHQRPKLERYDDTLFLVLKTVNYVPHESVVLARQIVETGEVMIFVGKNFVVTVRHGEHGELSEVRKRMDTDPEHLRLGSYAVMHAISDYVVDRYLAVTNLMEGDIDAIEEVAFAPGRKLNVEPIYLLKREVIELRRCVAPLSAALQRMQTDNKDLISKELRRYLRDVADHQTEAADQIASYDDMLNSLVQAALARVGMQQNNDMRKMAAWAGIVAMPTMVAAIYGMNFRFMPELNWTWSYPLVMAGMTIVCLVLYWQFRNRNWL

SEQ ID NO: 99 - DNA, 1128 bp, Deinococcus radiodurans
  CDS (1)..(1128)
atgatgtggcgcatggccgcttctcccgctgcggatgccacgtctccttcttcccagtcggcgccgccacgtcctccgacagacgccggaccgggcgaccctttgctggatggaagtggtcaacccgcgccccatgccgaggcgcatgtgttccgggacggcaaggtgcggcaccttccgctggacctgaacctcgcgcgtgggctgctggacgacccgcaggcgttcgtgtggttcgatctggtcaacccggaccccgccgacctcgaagccctgcgcgagccgttcgacctgcacccgctggcgatcgaggacgcgctcgtgggtgggcagcgggtcaaggtggagccctacgacaccttctggttcgtggtgctgcacggcgcctccttgccgtcgcaggaccgcttgcaactgcacgaaatggcgctgtttatcgggcaacggttcgtactgaccattcagcatcagccgctgttcgccgacgaggaaatcgtggagcgctggcaacttgtccccgccgcgtggcgttccagtgccagttcgctgacctacgtgattctggacaccatcgtggacaatctgcgcgagctgaccgaccagattgagcgcgaactgcgcgaggtccgcacgacgatgacgcgcagccaggtcgtgcatcccgagctgcttcagcgcattttttcgcttgaggaagtcacccatgaggcttacaccgtcgccctgtcgctgcgcgacaccctgccaactttcgtgcacgcgccggaggaggcgcctgtcggcggcccggcccaggcgccgtactaccgcgatgtccacgaccacgcgataggggtggtcgaacgcctcggcgccgagcgcgacctgagtcagcgggtgttcgacgtgtaccagtcgctcgccgctcagcaacagagtgaggtggcgcggcagctcacggtggtgtccaccatttttctgccgctgaccttcctcacggggtttttcggtcagaacttcgagtacctgactcagaagatagcgagcgagcgggcgttctgggtctggggtttcgggtcttatctgctgtcgctgctggcaatcgcctgggtcattcgccgggtgtcgcgttgggggcgtgacgggtaa

SEQ ID NO: 100 - protein, 375 aa, Deinococcus radiodurans
MMWRMAASPAADATSPSSQSAPPRPPTDAGPGDPLLDGSGQPAPHAEAHVFRDGKVRHLPLDLNLARGLLDDPQAFVWFDLVNPDPADLEALREPFDLHPLAIEDALVGGQRVKVEPYDTFWFVVLHGASLPSQDRLQLHEMALFIGQRFVLTIQHQPLFADEEIVERWQLVPAAWRSSASSLTYVILDTIVDNLRELTDQIERELREVRTTMTRSQVVHPELLQRIFSLEEVTHEAYTVALSLRDTLPTFVHAPEEAPVGGPAQAPYYRDVHDHAIGVVERLGAERDLSQRVFDVYQSLAAQQQSEVARQLTVVSTIFLPLTFLTGFFGQNFEYLTQKIASERAFWVWGFGSYLLSLLAIAWVIRRVSRWGRDG

SEQ ID NO: 101 - DNA, 1065 bp, Clostridium acetobutylicum
  CDS (1)..(1065)
atgtctagatatacaaaaggagtatctaaaaagaagggattaaagccaggcagtttgatacatgtaggaaattctacaggaaaaaaaacagaaatacatattattgattataaggatgattattttgaggaaaaggatgttcatagtattgatgagtgcttaaaatacagagatacagataatatgacatggataaatataaacggacttgaagatatagatttatatgaaaaggttggaaagtattttggagtccattcacttataatggaggatatactaaatactaatcaaagacctaaaatagaagagttcgaaaaatatatttttattgttttaaaaatgatatattttagggaagataaacttgtagttgagcaggttagtataatatgtatggaaaatcttattattacttttcaagaagaaggcaaggatggagatgtttttggaaatttaagagacagaattagaaatactaaaagtaaaataagaaaaacaggggttggatatcttacatatgcgttaattgattctatagttgataattattttgtgattttagaaaaggttgaagataaaattgaaaattttgaagagtctcttatgacaactgccacaaataatttatttaatgaagtatataatcttaaaagacaaatgatatttttatggaaagcagtttggcctttaagagaaataataaatacgcttcaaagaggagaagttgaaattataggaagcgatataagtatttattttaaagatgtttatgaccatactgtgcaggtaatagatacaatagagctctttagagatatgatagcgggacttcttgatacatacttatcgagtgctagtaacaaaatgaatgaaataatgaaatttttgactattttttcaacaatatttataccactttcttttcttgttggtgtatatggtatgaacttcgattatatgccagaacttaaattcagatatggatatgctgttctttgggtgattatgatatcactatctgcatttatgttaatgtattttagaaagaaaaaatggctttaa

SEQ ID NO: 102 - protein, 354 aa, Clostridium acetobutylicum
MSRYTKGVSKKKGLKPGSLIHVGNSTGKKTEIHIIDYKDDYFEEKDVHSIDECLKYRDTDNMTWININGLEDIDLYEKVGKYFGVHSLIMEDILNTNQRPKIEEFEKYIFIVLKMIYFREDKLVVEQVSIICMENLIITFQEEGKDGDVFGNLRDRIRNTKSKIRKTGVGYLTYALIDSIVDNYFVILEKVEDKIENFEESLMTTATNNLFNEVYNLKRQMIFLWKAVWPLREIINTLQRGEVEIIGSDISIYFKDVYDHTVQVIDTIELFRDMIAGLLDTYLSSASNKMNEIMKFLTIFSTIFIPLSFLVGVYGMNFDYMPELKFRYGYAVLWVIMISLSAFMLMYFRKKKWL

SEQ ID NO: 103 - DNA, 1143 bp, Nostoc sp. PCC 7120
  CDS (1)..(1143)
atgattagaaaacttcgtcgtcttgccaaagcagtcaataaaccatataaagatgagttctatcattaccctggaaccatccccggaactatcattattgatgcagatgcgccgccaccggaaatcgacttaattgactatagccaaactgattttactcatcaacgagttgccacaccggaagaatgcctaccctatttggataccagttctgtgacttgggtagatgtccagggtttgggtaatcaggacatcttagagcgagtggggcaagtttttgagttaccgcctctggttttagaagatgtggtgaatgtatcggaacgccccaaaacggaggattacgacgaccaattattatttattgcccggatggttgtacccaaggaaagggaatcagggttttatagtgagcaagtcagtctaattttaggtaagcactacctgttaagtattcaggaagaaccagagcatgattgctttgcaggcgtgaggatgcgaattgaaaaaggtaaaggaactatccgccgccaaggtgctgattatttagcttatgctttgctcgatgcgattattgatggttttttcccagttttggaacgttatggggaagcacttgaggatttagaggaagaagtaatcgttagtcctagtcgccaaacactgcaaaaaatttatcacgtgaggcgcgaattactgcaactgcgtcgggctatttggccgcaacgagatgcgattaatgctttaatacgcgatcgcagtcaactcattagcccggaggtgcaaatctatctccgcgattgttatgaccatgcggtgcaagtcatggatatggtggaaacctaccgcgagttagcctctggattgatggatgtatacttgtcagcagtcagtaacaaaatgaatgaagttatgaaactactgacagtggtttcatcaatctttattcccctaacttttgttgcaggtatatatggaatgaatttcaatacggaaaaatcgccatacaatatgcctgagttgaactggtattggggttaccccctgtgcttaggagttatgggagcgatcgcttttgcattactatttttattttggaaacgaggttggctagaaaattcttctatgattgagcgtgattaa

SEQ ID NO: 104 - protein, 380 aa, Nostoc sp. PCC 7120
MIRKLRRLAKAVNKPYKDEFYHYPGTIPGTIIIDADAPPPEIDLIDYSQTDFTHQRVATPEECLPYLDTSSVTWVDVQGLGNQDILERVGQVFELPPLVLEDVVNVSERPKTEDYDDQLLFIARMVVPKERESGFYSEQVSLILGKHYLLSIQEEPEHDCFAGVRMRIEKGKGTIRRQGADYLAYALLDAIIDGFFPVLERYGEALEDLEEEVIVSPSRQTLQKIYHVRRELLQLRRAIWPQRDAINALIRDRSQLISPEVQIYLRDCYDHAVQVMDMVETYRELASGLMDVYLSAVSNKMNEVMKLLTVVSSIFIPLTFVAGIYGMNFNTEKSPYNMPELNWYWGYPLCLGVMGAIAFALLFLFWKRGWLENSSMIERD

SEQ ID NO: 105 - DNA, 969 bp, Caulobacter crescentus
  CDS (1)..(969)
atgagcctgatcgccgccaccgcctacaaggccggacagccggtccgcgtgctggacctgtcctcgcccgaggacctggttccgcgcgagggcgaatttgtctggatcggcctggccgagcccgacgaggccgaactgcgccgcctgcagacggcgtttggcctgcacccgctggcggtcgaggacgcgctgcacgcccgccagacccccaaggtcgaggtctatggcgaccagctgttcgtggtggccaagaccgcccacctggagggtgaccgtatcgcctatggcgaaaccgacttcttcgtcggacgccagcacctgatcaccgtccgccacggcagcgcccgggcccataccgagctgcgcgcccagctggaggcggcgccggtccaactggcccacggggtcgactatgtgctgcacgcggtgctggacttcatcgtcgacggctacatgccgatcgtcgaccagatcgaggaagagcttcagggcatcgagcagcgcgcgctggacgccttcctcagccgggccgagatcacccgcatcttcgccctgcgccgctcgctgatgcggttcaagaagatgctgggcccgatggcccagatggccggcgccttggagcatcacgacctgccctgcatcgacagcgaggtgcggatgtacttccgcgatgtccatgaccacgtgcagcgcaccgagatcctggtcgacggcctgcgcgaggtgctgacctcagtgttcgaaatcgccagcctgctggaacagcagcgccagggggtgatcacccgccagttggccgcctgggccgcgatcctggcggtgcccacggcgatcgccgggatctacggcatgaacttcgagcacatgcccgagctgaagtggcagtacggctactacggcgtgatcggcgccatcgccgtggtctgcggcctgctgtaccagcgcttcaagaaggcgggctggctttaa

SEQ ID NO: 106 - protein, 322 aa, Caulobacter crescentus
MSLIAATAYKAGQPVRVLDLSSPEDLVPREGEFVWIGLAEPDEAELRRLQTAFGLHPLAVEDALHARQTPKVEVYGDQLFVVAKTAHLEGDRIAYGETDFFVGRQHLITVRHGSARAHTELRAQLEAAPVQLAHGVDYVLHAVLDFIVDGYMPIVDQIEEELQGIEQRALDAFLSRAEITRIFALRRSLMRFKKMLGPMAQMAGALEHHDLPCIDSEVRMYFRDVHDHVQRTEILVDGLREVLTSVFEIASLLEQQRQGVITRQLAAWAAILAVPTAIAGIYGMNFEHMPELKWQYGYYGVIGAIAVVCGLLYQRFKKAGWL

SEQ ID NO: 107 - DNA, 2412 bp, Schizosaccharomyces pombe
  CDS (1)..(2412)
atgtcttttcaacaaccttccaacggagctcaaggaggaaacaacaatgcattagagaaaacctcctccaacgaagctacttcttcttcgtccacccaggtttcgtccctctctgcaagtggcatttcggtaagtactcctcgtgtttctccatttgaacctgagagaaatatgcaggttcaatcatctcagcatcttgaagcaaatgtgcaaagtcccgtttcgtctcagacaacttatgccactccttctgcatatgccgtacctcaggagtctgaaatagaacttcatgaatctgaaatggtgcctcaaaagcccaagaaaaagaagcgttctcgaaggaatcgcaaagcatccaggaagaaaatacccgccactcagagttcctctgctgatatggacacgttgcatgtttgcccgacatgcggttcttgttcggattcaaagaaaccacagtcgaacaagaaacatcgtggtagacgtgtcaaacacagcccaaagtctaccctggaggtacctgatggtattccggatatcaaagctttatctgcttccatgggttcctcttctcaacatgcaagccgctataacgaaggtcgcggaagttttgatactctcggtacacattaccatcttagcaaaagtcgtaaatcttcctcaagcgattctctttattcggtgtcctctatgagtataaagaatgattcaaattctgattcgttatcttcgagttcttcttccgatgtttctggcagtgacgaaaatttacctatagacaagacattgtacctctctgtcgaggatccttcatttatggttcatccccgtagacctagtgctaccaagtcttgctccgccgcggtagactgtccgcacaccactattccaaaacccccctaccagtcggatacagatctcaccgaacttccaacgaagtccactgctcagttttccgatgagacgtttactgttcaaccaagacttaagagcacacattcttctattgcagacaatgaggaccgtgaagttgattctcaagtcgatgagaatacacgggtcgttgaggaagatgtgtgctttcctatgcaagaagaatcgcatgtcaataagggaattgatttcgatgaacttgacaatttcgcagaagaggaacttcaaaaacaaaggcagaatactgatcactttcgctctaggcaatatagtacttgtaagccttttgagcctcactggaatgacttaagtccacacgatcctaatgatccctctagctccttgcactccaataatgcagaaaaagctgcagaggttcctcttcggtcttcttactattccggcgggagacgatctgttacttctatgtcggattctccctatcggtttagtttcttttcatctaatcaaaatgaaactatccatgcatctgtattatcggatttactggatgacggggcgactagtttccgctccttattttgtccagagaagggtgtttggtggttggattgtttagatcctactgatatagaaatgcgtgtactttcgaaggcattctcgattcatcctttgactacagaagatattcgtgttcaggaagcaagagaaaaagttgagcttttcggttcctactatttcgtttgttttcgatcttttgaacaggatcccgagctagccaactatttggagcctttgaacatgtatatcgttgtttttagagagggcttgttaaccttccactttagttcagctacccatccagcttctgtgcgacgtcgtgctcgacaacttcgagattatgtgcatgtttcctctgactggctttgttacgccctcattgatgacattacggatgcatttgttccgttgatccgtggtattgaaactgaaaccgaggctattgaagactcggtacttgttgggcgtagtgaagattcttctgatatgttgagacgaattggtgaatgtcgcaaaaagacaatgggaatgttccgacttttatatggaaaggcagatgttattaaaatgctcgctaagagatgcaatgaaaaatggactattgcccctactggtgaaattggtctttaccttggagacattcaagaccatttagtcaccatgacttccaacctttcccagtttgagaaaatcttgtcacgcacacacagtaattaccttgcacaattgacctcaaattcaatcgaagagaattctcgcactaacggtgccttaggtaaaattacccttattggtactttgcttgttcccatgaacttggtcaccggtttattcggcatgaacgttccagtccctggaagagatactaacaatttggcttggttctttggtattctgggtgtgttattgggttcaattgcaattggctggattattactatgcgatacaatgccttttaa

SEQ ID NO: 108 - protein, 803 aa, Schizosaccharomyces pombe
MSFQQPSNGAQGGNNNALEKTSSNEATSSSSTQVSSLSASGISVSTPRVSPFEPERNMQVQSSQHLEANVQSPVSSQTTYATPSAYAVPQESEIELHESEMVPQKPKKKKRSRRNRKASRKKIPATQSSSADMDTLHVCPTCGSCSDSKKPQSNKKHRGRRVKHSPKSTLEVPDGIPDIKALSASMGSSSQHASRYNEGRGSFDTLGTHYHLSKSRKSSSSDSLYSVSSMSIKNDSNSDSLSSSSSSDVSGSDENLPIDKTLYLSVEDPSFMVHPRRPSATKSCSAAVDCPHTTIPKPPYQSDTDLTELPTKSTAQFSDETFTVQPRLKSTHSSIADNEDREVDSQVDENTRVVEEDVCFPMQEESHVNKGIDFDELDNFAEEELQKQRQNTDHFRSRQYSTCKPFEPHWNDLSPHDPNDPSSSLHSNNAEKAAEVPLRSSYYSGGRRSVTSMSDSPYRFSFFSSNQNETIHASVLSDLLDDGATSFRSLFCPEKGVWWLDCLDPTDIEMRVLSKAFSIHPLTTEDIRVQEAREKVELFGSYYFVCFRSFEQDPELANYLEPLNMYIVVFREGLLTFHFSSATHPASVRRRARQLRDYVHVSSDWLCYALIDDITDAFVPLIRGIETETEAIEDSVLVGRSEDSSDMLRRIGECRKKTMGMFRLLYGKADVIKMLAKRCNEKWTIAPTGEIGLYLGDIQDHLVTMTSNLSQFEKILSRTHSNYLAQLTSNSIEENSRTNGALGKITLIGTLLVPMNLVTGLFGMNVPVPGRDTNNLAWFFGILGVLLGSIAIGWIITMRYNAF

SEQ ID NO: 109 - DNA, 2910 bp, Saccharomyces cerevisiae
  CDS (1)..(2910)
atgagcactgataactcacaaaaggatgaaggtgttcctttgctttccccttactctagtagccctcaactaaggaaaaagaagcgcaatcaaaaaagaagaaaggacaagtttgttggtcacttgaagtcagactcacgtaggccaacgcaactgctgcatgataatctgcaacacaatcacggccagattactgatttcgaccagatcgattcctggggcatgctgcatgaatctgattctacaagtaatgatataataaaaagtgaggatccatcgctcaagggcgcgttcattgatcatagaccttcaatgagccaacctagggaggggcctcaaagtgtatcaagcacagttcaaccacagccaataatgaagttttcaacaccaagttacaagaaacccgcagggttaagaccctctgatcagaatagatcattagtatcggacttatccccttcagagcttgaatcatggctgaagagaaggaaatctgttcataagagttttgttgacgaaaactcccccaccgataggagacaatcgaacgcgaataatgatgtcgtgattgatgttgatgcgttaatgaaccatgttaacaacaatgcaagtactggggttaatgataacagcaagagaagaaagaaaaagaggggttctgatgatagtagcaacaaaaattccaaatccacatccagtgattcaaacgatgaagaggatgagtataactcaaggccatcttctagtctttcttcaaataactcttctttggatgacgtttgtttagtgcttgatgatgagggtagcgaagtgccaaaagcttggcctgattgtactgttttggaagaattttccaaggaagaaacagagagactaagaagtcaagctattcaagatgctgaagctttccacttccaatacgatgaagatgaggaagatggaacatcaaatgaagatggaattcttttttcaaagccaatcgtaactaatattgatgtccctgaattgggaaacagaagggtaaacgaaacagagaatttgaagaacggccgtttaaggccaaaaagaattgcgccatggcatttgattcaacgtccaatggtccttgggtccaattcaaccaaggactcaaaatcaagaattcaaagcggattacaagataacttactagtcggcagaaatattcaatatcctccgcatattatttctaataacccagaacatttcaggttcacttattttagggtggatttggactctactgttcattctccgacaatatctggtttactgcaacctggtcaaaaatttcaagatttatttgtcgcttctatatactcccaagataatagcgctggtcatatcaagacacatccaaattctccaacacctggtataaaagcagaaactgtatctcaactccagggattgacagctaaaaacccttccactttatcgtctatgtctgtggcaaatatagaggatgttcctccattctggttggatgtcagcaatcctactgaagaggagatgaaaatattaagtaaagctttcggaattcaccctttaactacagaagatatttttttgggagaagttcgtgagaaagtggaactatttagagattattacctgatttgttttagaagtttcgatattgtagcagaaaagcatgttcgtcggaggagaaaagaaaagcaagaatctgctaccttggatcatgaaagtatttcacgtcgtaaatcacaagcctatggtgctactatgtcaaatgaatcaaatgcaaataacaataacagtacaagcaatgcaagtaggagcaaatggcttccatcgattttacgtgcacgccgtcggtcatctgcaaatagaacaaccaatacatcatcatcaagctataaacgccgtgtcaaaagcgaaaagaaaaagatggaagagaacgaaaaattcaaaagaaaatcaggagacaggcacaaaccacgtgagggagaattagagccattgaatgtttacattattgttttcagaactggtgtattgacgtttcattttgctcccacaccacatcctattaatgttcgaagaagagcaagactactaaaggattaccttaatgttacctctgattggattgcgtatgccttaatcgatgacattacagacgcatttgcccctatgatagaacttatcgaagatgaagtttatgagattgaggacgccattttgaagatgcatcagtcagatgattctagtgatagcgattctagcgatagtgattccgattcgggcgctagcgatgaggatgcatttccgttcgatgtctattctaaaaagacgtcctactctagtgcaaaatctagtgtgagttcaagaagtatgagcacttctgaagcgtcattcaatgcaaatttgataggttggaagagaaaaggagatatgttgaggcggattggtgaatgccgtaaaagagtgatgagtatactaagattgctaggatccaaggctgatgtgataaaaggatttgccaaaaggtataatgagcaatgggaagcttcgccacaatctgaaatcgcaatgtatttgggtgatattcaagatcatattgtaaccatggtctcatcgctaaaccattatgaaaaactgttaagtagatcgcattcaaattatctggcacaaatcaacattgatatgacgaaggttaataatgacatgaacgacgttttgggaaaaattaccatactgggtactattgttctgccaatgaatgtgattacgggtctgtggggtatgaatgttatcgtgcccggacaatacagggattcgttgacatggtttataggcattgtgctttttatgtgtatgctagcatgttctgcatatatgtatactaagagaagattcgggttttaa

SEQ ID NO: 110 - protein, 969 aa, Saccharomyces cerevisiae
MSTDNSQKDEGVPLLSPYSSSPQLRKKKRNQKRRKDKFVGHLKSDSRRPTQLLHDNLQHNHGQITDFDQIDSWGMLHESDSTSNDIIKSEDPSLKGAFIDHRPSMSQPREGPQSVSSTVQPQPIMKFSTPSYKKPAGLRPSDQNRSLVSDLSPSELESWLKRRKSVHKSFVDENSPTDRRQSNANNDVVIDVDALMNHVNNNASTGVNDNSKRRKKKRGSDDSSNKNSKSTSSDSNDEEDEYNSRPSSSLSSNNSSLDDVCLVLDDEGSEVPKAWPDCTVLEEFSKEETERLRSQAIQDAEAFHFQYDEDEEDGTSNEDGILFSKPIVTNIDVPELGNRRVNETENLKNGRLRPKRIAPWHLIQRPMVLGSNSTKDSKSRIQSGLQDNLLVGRNIQYPPHIISNNPEHFRFTYFRVDLDSTVHSPTISGLLQPGQKFQDLFVASIYSQDNSAGHIKTHPNSPTPGIKAETVSQLQGLTAKNPSTLSSMSVANIEDVPPFWLDVSNPTEEEMKILSKAFGIHPLTTEDIFLGEVREKVELFRDYYLICFRSFDIVAEKHVRRRRKEKQESATLDHESISRRKSQAYGATMSNESNANNNNSTSNASRSKWLPSILRARRRSSANRTTNTSSSSYKRRVKSEKKKMEENEKFKRKSGDRHKPREGELEPLNVYIIVFRTGVLTFHFAPTPHPINVRRRARLLKDYLNVTSDWIAYALIDDITDAFAPMIELIEDEVYEIEDAILKMHQSDDSSDSDSSDSDSDSGASDEDAFPFDVYSKKTSYSSAKSSVSSRSMSTSEASFNANLIGWKRKGDMLRRIGECRKRVMSILRLLGSKADVIKGFAKRYNEQWEASPQSEIAMYLGDIQDHIVTMVSSLNHYEKLLSRSHSNYLAQINIDMTKVNNDMNDVLGKITILGTIVLPMNVITGLWGMNVIVPGQYRDSLTWFIGIVLFMCMLACSAYMYTKRRFGF

SEQ ID NO: 111 - DNA, 2580 bp, Saccharomyces cerevisiae
  CDS (1)..(2580)
atgtcatcatcctcaagttcatcagagtcatcgcctaatttatcgcggtcaaactcactggctaacacgatggtttccatgaaaacagaagaccatacgggattgtacgaccataggcagcaccctgactcactgccggtccgtcaccaacctccaacattgaagaacaaggaaattgctaagtccactaaaccttctattcctaaggagcagaagagtgcaacgagatacaacagccatgtggatgtgggaagcgtacccagtaggggccgcatggattttgaagatgaagggcagggtatggatgaaacggttgctcatcatcaattgagggcatctgccattttaacttctaacgcgaggccttccagactagcccactccatgccacatcaaaggcagctttatgtggaaagtaatatacacacaccaccaaaggatgtaggtgtaaagagagactatactatgtcatcttctactgcatcatcaggtaacaaatccaagctgagcgcatcttcctcggcaagtcctattacgaaggttagaaaatcttcgctggtcagtcctgttcttgagatcccacacgaatcgaaatctgatacacactccaagctggctaaacccaagaagaggacatattctaccacatctgcgcattcatctatcaatcccgcagttttactgacgaaaagcacatcccaaaaatcggatgcagatgatgatacattggaaagaaaaccagtacgtatgaatactagagcttcttttgatagtgacgtatcacaggcgtcgagagattctcaagagacggaagaagatgtttgtttccctatgccaccacaattgcataccagagttaacggtatagatttcgatgaactggaagagtacgctcagtttgcaaacgcggagaagagtcaatttttggcaagtctgcaagtgcccaacgaacagaagtacagtaacgtttctcaggatatcgggtttaccagctctacttccacttcgggatcatcagctgccctaaaatatacaccaagagtttcgcagactggtgaaaagagcgagagtaccaatgaaacagaaatccatgaaaagaaggaagacgagcatgagaaaatcaagcctagtttacaccctggtatatctttcggtaaaaataaagttgaaggggaagagaatgaaaacattccatccaatgacccggcgtattgctcttaccagggtacagactttcaaattcctaatagattttcttttttctgttccgaatctgatgaaaccgttcatgctagtgatatcccttccttagtgtctgagggacaaacattctatgaattattcaggggaggtgagccaacatggtggttagattgtagttgtccaactgatgatgaaatgcgttgcatagcaaaggcgtttggtatccatccattgactgcagaagatatcagaatgcaagaaacacgtgaaaaggtggaacttttcaaatcgtattacttcgtttgtttccatacctttgaaaatgataaagaatcagaggatttcctggaacctattaacgtttacattgttgtctgtaggtcaggtgttttaacattccattttggcccaatatctcattgtgctaatgtcagaaggcgtgtaagacagttacgtgactatgtcaatgtcaattcagattggttatgttatgctttaatcgatgacattactgatagtttcgctcctgtaattcaatctattgaatatgaagcagatgcaatcgaagattctgtgttcatggctcgtgacatggattttgcagcaatgttacaaagaattggtgaaagtaggcgtaagacaatgacgttgatgagacttcttagtggtaaggctgatgttatcaaaatgtttgccaaaagatgccaagatgaagctaatggtattggaccggcactaacatctcaaataaatattgctaacttacaggcaaggcaggataacgccagtcatatcaaaaataatagttcgacaactgtaccaaataattatgcgcccaccacatcacaaccgaggggggatatcgccctatacttgggtgatattcaagatcatttgttgacaatgtttcaaaatttgctggcgtacgaaaaaattttttctagatcccatacaaactacttagctcaactgcaagtggaatcatttaattctaataataaagtgacagaaatgttgggtaaagtcaccatgataggtacaatgctagttccattaaatgttatcactggtcttttcggtatgaatgttaaagttccgggggagaattccagtatcgcgtggtggtttgggatattgggtgtgctgcttttgctggccgtccttggttggttcttggccagctattggattaaaagaatagaccctcctgcaacacttaacgaggccgctgaaagtggagccaaatcggttatttcgagcttcttgccaaaaagaaacaagagattcaatgatcgttccaaaaatataaatgtaagagccggtccttcaaacaaatcagttgcaagtcttcctagtagatatagccgctacgactaa

SEQ ID NO: 112 - protein, 859 aa, Saccharomyces cerevisiae
MSSSSSSSESSPNLSRSNSLANTMVSMKTEDHTGLYDHRQHPDSLPVRHQPPTLKNKEIAKSTKPSIPKEQKSATRYNSHVDVGSVPSRGRMDFEDEGQGMDETVAHHQLRASAILTSNARPSRLAHSMPHQRQLYVESNIHTPPKDVGVKRDYTMSSSTASSGNKSKLSASSSASPITKVRKSSLVSPVLEIPHESKSDTHSKLAKPKKRTYSTTSAHSSINPAVLLTKSTSQKSDADDDTLERKPVRMNTRASFDSDVSQASRDSQETEEDVCFPMPPQLHTRVNGIDFDELEEYAQFANAEKSQFLASLQVPNEQKYSNVSQDIGFTSSTSTSGSSAALKYTPRVSQTGEKSESTNETEIHEKKEDEHEKIKPSLHPGISFGKNKVEGEENENIPSNDPAYCSYQGTDFQIPNRFSFFCSESDETVHASDIPSLVSEGQTFYELFRGGEPTWWLDCSCPTDDEMRCIAKAFGIHPLTAEDIRMQETREKVELFKSYYFVCFHTFENDKESEDFLEPINVYIVVCRSGVLTFHFGPISHCANVRRRVRQLRDYVNVNSDWLCYALIDDITDSFAPVIQSIEYEADAIEDSVFMARDMDFAAMLQRIGESRRKTMTLMRLLSGKADVIKMFAKRCQDEANGIGPALTSQINIANLQARQDNASHIKNNSSTTVPNNYAPTTSQPRGDIALYLGDIQDHLLTMFQNLLAYEKIFSRSHTNYLAQLQVESFNSNNKVTEMLGKVTMIGTMLVPLNVITGLFGMNVKVPGENSSIAWWFGILGVLLLLAVLGWFLASYWIKRIDPPATLNEAAESGAKSVISSFLPKRNKRFNDRSKNINVRAGPSNKSVASLPSRYSRYD

SEQ ID NO: 113 - DNA, 2769 bp, Candida albicans Yeast
  CDS (1)..(2769)
atgtccgatagtgaaagttattatcaaaattcaactactaatcaacctattcctagatctgatgaagtattggatgatcatagaaatcaaatcactaatgattgtgccattagtgatagtgaagatgagttggaattaaaatcagaattagaatcagaagttgtaaaaagcgaaaaacaacaacaacatcatcaagagattacatcagataatgctaaaccattgactcgtaaatctggttcttcaattaagaaaaaatctaatcttaccgataaagatagaattaccaaccctatgagtttatctggtggtgatgatactattaacagcggtcacaaaaatcgtaattataacatgagttcattacgtaaagatttttatttaaaagataatactgacgacaattctactaataatcatactcatcttgcaattccaattccaattccaattccaaccccaattattactaatgctaataaatcaagaagaaaatctcaattggaaaatttacctccattaattaaaaagaaaacaattggtcgtaataattctaataattttgaaaatgatttagttagtcccatgacaaaaatgaaaactaatgatagtgaagatattactaatactagcaccactgctaatcatatgaaacttggtattggtgctacaacccttggtgttggaactggtactaccgccactgccactgccactgctgctgctggtagaagaccatctcgttcatctattgatagtgaagctgattctcatgcatcaagatcatctcaagaaactgaagaagatgtttgttttcctatggttggtgatcatattagagttaatggaattgattttgatgaaattgatgaatttattagagaagaaagagaagaagcttatttacaaaaacaaatgattgctaaaaatattagccgtattgatgaatttcaaaatctttccaaaaataatactactagtggtgcatctcgtcatccatatcatcatcacagtaataataataaaaaaaataatggtggtgatggtggtggttctagtatggcagcattaaaatatactccaaaaaatattttaaagaaaacattatcaagatttgaatttactcatgaaaattcttcatcttcagaagaaatttatgaattgaagactaaacaacaaccaccttacaaatatgatgatcaattatcattaacttcatctacatcttctacttctggatctggatctgggcaggtgaaatttggtggagcaagaatttctgatgggattaatggaggttcattacctgatagattttcacttttccattctgaatcagaagaaactattcatgcccccgatattccatcattagtatcaccaggtcaatctgttcgagatttatttagaaatggtgaagaaacttggtggttagattgtacttgtcctactgattcggaaatgaaaatgttggccaaagcatttggtattcatcctttaactgctgaagatattcgaatgcaagaaactcgtgaaaaagttgaattatttaaaagttattattttgtttgtttccatacttttgaagctgataaagaatctgaagattatttagaaccgataaatgtttatattgttgttttccatgatggtatattaacgttccatttttcaccaatttctcatccagcaaatgttagaagaagagttcgtcaattgagagattatgtcgatgttagtgctgattggttatgttatgccttaatcgatgaaattaccgatggttttgcccccgtgattcatggaattgaatatgaagctgatgccattgaagatgccgttttcactgctagagatactgattttagtagtatgttacaaagaattggtgaatcaagaagaaaagtcatgactttaatgagattattatcaggtaaagctgatgtcattaaaatgtttgctaaaagatgtcaagaagaagctaattcttcttctggttattatcaacgtcaatataacttacaacaacaacaacaacaggccccaccaccaccacctaatcctattattacttcaccaattaattcaactttgaatcttaatagtttaggaacttcaactggtggaggagtaggagtaggaggaattaattttggtcccaatccaactggaaataatactaatactaatactaatactactggttcaccttcaccacctcaacaacaacaacaacatggtatcactaacaaatctttccccatccccgatgcacgtccaagagctgatattgcattatatttaggtgatattcaagatcatataatcaccatgtttcaaaatttattagcctatgaaaaaattttcagtcgttcacattcaaattatttagctcaattacaagttgaatcattcaattccaataataaaatcaccgaaatgttttctaaaattactttgattgggacaatgttagttccattaaatttagtcacgggactttttggtatgaatgtaagagtccctggtgaaggtggtaccaatttaggttggtttttcggaattgttggagtattaatatttataattattggatcatttatatttgctcaatggtggttgaaaaaattgaataattcaattgaaggacaaaataatggtaatcgaccaatttttaatcattcatcaagaagatcaattagaagtttaggtttaaaaaaacatggtggtaataaatcaattattagtttccccaataaatatgaataa

SEQ ID NO: 114 - protein, 922 aa, Candida albicans Yeast
MSDSESYYQNSTTNQPIPRSDEVLDDHRNQITNDCAISDSEDELELKSELESEVVKSEKQQQHHQEITSDNAKPLTRKSGSSIKKKSNLTDKDRITNPMSLSGGDDTINSGHKNRNYNMSSLRKDFYLKDNTDDNSTNNHTHLAIPIPIPIPTPIITNANKSRRKSQLENLPPLIKKKTIGRNNSNNFENDLVSPMTKMKTNDSEDITNTSTTANHMKLGIGATTLGVGTGTTATATATAAAGRRPSRSSIDSEADSHASRSSQETEEDVCFPMVGDHIRVNGIDFDEIDEFIREEREEAYLQKQMIAKNISRIDEFQNLSKNNTTSGASRHPYHHHSNNNKKNNGGDGGGSSMAALKYTPKNILKKTLSRFEFTHENSSSSEEIYELKTKQQPPYKYDDQLSLTSSTSSTSGSGSGQVKFGGARISDGINGGSLPDRFSLFHSESEETIHAPDIPSLVSPGQSVRDLFRNGEETWWLDCTCPTDSEMKMLAKAFGIHPLTAEDIRMQETREKVELFKSYYFVCFHTFEADKESEDYLEPINVYIVVFHDGILTFHFSPISHPANVRRRVRQLRDYVDVSADWLCYALIDEITDGFAPVIHGIEYEADAIEDAVFTARDTDFSSMLQRIGESRRKVMTLMRLLSGKADVIKMFAKRCQEEANSSSGYYQRQYNLQQQQQQAPPPPPNPIITSPINSTLNLNSLGTSTGGGVGVGGINFGPNPTGNNTNTNTNTTGSPSPPQQQQQHGITNKSFPIPDARPRADIALYLGDIQDHIITMFQNLLAYEKIFSRSHSNYLAQLQVESFNSNNKITEMFSKITLIGTMLVPLNLVTGLFGMNVRVPGEGGTNLGWFFGIVGVLIFIIIGSFIFAQWWLKKLNNSIEGQNNGNRPIFNHSSRRSIRSLGLKKHGGNKSIISFPNKYE

SEQ ID NO: 115 - DNA, 1065 bp, Streptomyces coelicolor
  CDS (1)..(1065)
atggcacggctggcgcaacgccgtgcgcgggtcgacctgagtcaccccgccaggtcgcccctgggctccgcggtggtgaactgcgtgatgtatcaggacggcgtacggatgccgggcggtcacgatctggtcgaggccgtggagcgggtccgcaagaaggacgacggcttcgtctggctcgggctgcacgagccgacggaccaggagttcgcgggcatcgccgagctgttcgacctgcatccgctggcggtcgaggacgcggtggaggctcatcagcgcccgaagctggagcggtacggggagacgctgttcgcggtcttcaagacggtctgctacgtcgagcacacggagctgaccgcgacgagtgaggtggtgaacacgggcgagatcatggtgttcatcggccccgccttcgtgatcacggtgcggcacggccggcatggttctctcggccccctgcgcgaggagctggaggccacaccgcagcagctcgccaaggggccggccgcggtgctgcatgcgatcgcggaccatgtcgtcgacgactatctgagcgtcacggacgcggtgcaggaggacatcgaccaggtcgagacggatgtgttcgcggcgagcggtgcgcgggtcgacgcgggacgcatctaccagctcaagcgcgaactcctggaactgaagcgagcggtgatgccactcagccgccccgtacaggagctggccacccggccgatccgagtgatcgaccaggagatacaggcgtacttccgggacgtctccgaccacctgctgcgggtgtccgagcagatcgccgcgttcgacgaactgctcaactcgatcctgcaagcgcatctcgcgcaggtcagcgtcgcgcagaacgaggacatgcggaagatcaccgcgtgggcctcgctcatcgcggtgccgacgatggtgtgcggtgtgtacggcatgaacttcgagttcatgcccgagctgcactggaggttcggctacccgatggtcatggccgtcatagccgtgggctgcgtcactctgtaccggggcttcaagcgcaacgactggctgtga

SEQ ID NO: 116 - protein, 354 aa, Streptomyces coelicolor
MARLAQRRARVDLSHPARSPLGSAVVNCVMYQDGVRMPGGHDLVEAVERVRKKDDGFVWLGLHEPTDQEFAGIAELFDLHPLAVEDAVEAHQRPKLERYGETLFAVFKTVCYVEHTELTATSEVVNTGEIMVFIGPAFVITVRHGRHGSLGPLREELEATPQQLAKGPAAVLHAIADHVVDDYLSVTDAVQEDIDQVETDVFAASGARVDAGRIYQLKRELLELKRAVMPLSRPVQELATRPIRVIDQEIQAYFRDVSDHLLRVSEQIAAFDELLNSILQAHLAQVSVAQNEDMRKITAWASLIAVPTMVCGVYGMNFEFMPELHWRFGYPMVMAVIAVGCVTLYRGFKRNDWL

SEQ ID NO: 117 - DNA, 1071 bp, Methanosarcina acetivorans
  CDS (1)..(1071)
atgaaatcgggaactttcagaaggaaacagtcaaaagtcgggcttgcccccggaactcttgtgcatgtaggagaaaaaaaggcagaaaaagtcacaattcgggtctggatctataacgacgaggaactgatagaaaaagaactgcagaccatagatgagtgccaggccctcaaaaaccagcccggaatgaaattatggataaatgttgacgggctcgacaggattgaggttatagaaaaactcgggagctgttttaagatccaccccctgactctcgaggacatactcaacgcggggcagcgccccaagatggaagactacgattcctacatctacactgtcttaaaaatgatgctcctcgatacggaaaacgaagaaattgttatcgaccaggtgagcatcattatcgggcccaactatatcctgtcttttcaggaaagggaaggagacgtttttgatcttctcagggaaaggctcaaaaatcccgcttctcgcctgcgaaagggtggggtggactaccttgcctacggccttattgacgctataatcgacaattattttctgattctcgaacatttcggggaaaaaatagaggatcttgaagacgaactcgtcagagacccggaccccgataccctgaaaataatccagaaatacagaagagatatgattctccttcgcaaatcagtctggcccctcagggaacttattaacggcctccagaaagtagagtccgagcttatcacggaagcgacgcagatttatctgagggatatttacgaccataccatccaggtcatagactcaatagaagctttccgggatatccttgcctcaatggtcgatgtctacctgtccagcgtgagcaacaggatgaacgacatcatgaaagttctgacaattatagccactatcttcattcctttgaccttcattgcaggagtatacggtatgaattttgattacatgcctgaactcaggtggcactggggttaccctgtagtcatgcttagcatgatgttactgggaataagcatgtttttttattttaaaaagaaaaggtggatctaa

SEQ ID NO: 118 - protein, 356 aa, Methanosarcina acetivorans
MKSGTFRRKQSKVGLAPGTLVHVGEKKAEKVTIRVWIYNDEELIEKELQTIDECQALKNQPGMKLWINVDGLDRIEVIEKLGSCFKIHPLTLEDILNAGQRPKMEDYDSYIYTVLKMMLLDTENEEIVIDQVSIIIGPNYILSFQEREGDVFDLLRERLKNPASRLRKGGVDYLAYGLIDAIIDNYFLILEHFGEKIEDLEDELVRDPDPDTLKIIQKYRRDMILLRKSVWPLRELINGLQKVESELITEATQIYLRDIYDHTIQVIDSIEAFRDILASMVDVYLSSVSNRMNDIMKVLTIIATIFIPLTFIAGVYGMNFDYMPELRWHWGYPVVMLSMMLLGISMFFYFKKKRWI

SEQ ID NO: 119 - DNA, 1071 bp, Methanosarcina mazei Methanosarcina frisia
  CDS (1)..(1071)
atgaaaccgagtactcccggaagaaaacaatcaaatgtcggtctcgcccccggaactctcgtccatgtcggggaaaaaaaggcagaaaaaaccgttattaaagcctggttatacaacagtgaaaaacttatcgaaaaggagcttcaaaccgtagatgagtgtcaggaacttaaaggtcagcccggcatgaacctgtggataaacgtagatgggctggaccagataggaattatagaaaaactgggaggttactttggggttcaccctctcactcttgaggatgtattgaacaccggacagcgcccaaaaatggaggattacgattcttatatttatgctgttcttaaaatgatgctcctcgatgaagaaagagaagagattcttattgaccaggtaagcattatctttggcaccaactacattctttcttttcaggaaagggaaggagacgcttttaaccccatccgcgacaggttaaaaaactctgcctcgcgcctgagaaagaacggagtggaccttcttgcatacagccttatagatgctgtggttgataactattttttgatccttgaacatttcggggaagaaatagaggacctcgaagaacagcttatagttgaccccatgcctgaaaccctgaaagcgatccagaagtataagagagatatgatcacactccgcaggtcagtctggcctctcagggagttaataaatagccttcagaggacggagtcccagcttataaaggagagtacgcagatttaccttcgggatgtatacgaccacacaattcaggttattgattccatagaagccttcagggatatcctttcttcaatggtagatgtctacctctcgagcctgagccatagaatgaatgacattatgaaagtcctgacgataatcgccacgatctttatccctcttacttttattgcaggagtatatggcatgaacttcgaatacatgcccgaactcaaatggcgatggggttaccctgcagtaatgtttgcgatgacgatacttgggataagcatgtttctctactttaagaaaagaaggtgggtataa

SEQ ID NO: 120 - protein, 356 aa, Methanosarcina mazei Methanosarcina frisia
MKPSTPGRKQSNVGLAPGTLVHVGEKKAEKTVIKAWLYNSEKLIEKELQTVDECQELKGQPGMNLWINVDGLDQIGIIEKLGGYFGVHPLTLEDVLNTGQRPKMEDYDSYIYAVLKMMLLDEEREEILIDQVSIIFGTNYILSFQEREGDAFNPIRDRLKNSASRLRKNGVDLLAYSLIDAVVDNYFLILEHFGEEIEDLEEQLIVDPMPETLKAIQKYKRDMITLRRSVWPLRELINSLQRTESQLIKESTQIYLRDVYDHTIQVIDSIEAFRDILSSMVDVYLSSLSHRMNDIMKVLTIIATIFIPLTFIAGVYGMNFEYMPELKWRWGYPAVMFAMTILGISMFLYFKKRRWV

SEQ ID NO: 121 - DNA, 561 bp, Schizosaccharomyces pombe Fission yeast
  CDS (1)..(561)
atgccatccaatacatcccggtcagtgcctacgggcttttattacaaacaaaatgctaggatgcagaacaggcctagattttctgatcgtaaacactcgagtaaatctaaacatcgatttccagtggaccctagtttgcaaccagacgaagcggatgagggaacaagattattgggaaacagtgatagtgatctattagaaccaccgtctgagcattcaagtaatggggaagatgacaaggatattaataaccctccttcaatgcctagttctgtttgttcttccccgaaaagtccacaccgtcactatgaaagcgatgaagacatcgaaaatatatcactgccggaaagccatccagaggacattcaaaggaaagaatttgagacggaaaatgggaagaatacaagagatcaacctagtccacttgctgaggtcagtgactttgctatttcatccccccatgtctaccctaaatcagctaattctcatgatagtcactatgaacagtttgcaaacaacgacgtgactgagagtgctgttgatgatcatccggctacttaa

SEQ ID NO: 122 - protein, 186 aa, Schizosaccharomyces pombe Fission yeast
MPSNTSRSVPTGFYYKQNARMQNRPRFSDRKHSSKSKHRFPVDPSLQPDEADEGTRLLGNSDSDLLEPPSEHSSNGEDDKDINNPPSMPSSVCSSPKSPHRHYESDEDIENISLPESHPEDIQRKEFETENGKNTRDQPSPLAEVSDFAISSPHVYPKSANSHDSHYEQFANNDVTESAVDDHPAT

SEQ ID NO: 123 - DNA, 2469 bp, Neurospora crassa
  CDS (1)..(2469)
atggatctaaatacccccccacggcacgatgcctcggcgtcgaactcggggccatccgcaggccaacctcctcaaaaccaaccatctcgaagaagaaagaaccatagagcgggcaagaagaagaagaagaatagaagaacttctttcggcgtcacctccgaggatatggcccaggagagaatgaatgataaggcgcttgcggaagccagaaacggtttttattcgcagcccggaaacaacttcagcaatacaagcattgatagcgaggcgcttttggatcatagagaacaacaaccattcctacgacctagacggccatcgatgttagtatcgcaaagttcgcatttgacaacaccacaggtcgcgagcaggcttaaaacagtggtggccagcagcaacaacagcgaagacgagcacgaaggagcaccccttctctctagttccgtattccagagaagcgaaggctttgcaggttatggttcaaacgacaccgcgcgaagggattcagtcgccagtcgtcttgaatcaagcagggacagcagcaaaaggagacgggccacatcacttggcgcaaccggcacagaaggctataatgtcaactatcctccatcagtgcctggaactcctcccatgggcgcaaccgatcgcgatctaagcatgagcttcggcgatatcatgatgcgggatgatgtcaactccatgccgaattcccctggcaggcgaactctaaatgaagagagcgacttggtaggatctctggaacgacgacacacaatcgcattacaggctgaggaggacgtgtgctttccccaggatggcctctctgaaatcgctgacgaggatcttcgcactcgtgatcccactgcgtatcgcatgaagagaagacggcgcggcaaatggccggatcttgctatcttggaggaatggagcaggtatgagaaggaaggcagaagtgaggagcgccatgcaaaaaagatcacagaacctcagttgatcaacggacgactaagaccagtccaccgtggctggtaccgggctcaggaagatgctccttatcgcttcacatacttcaatgaagaattccagagtactattcacagccagaccatttcagaactggtcccgccaggaggctcctttagacagctcttcatccccgatccaccactcctttcagattcctctgatgacgaagatgacgaagaggatcagcgtcatgtcggtctagatgaagttctaggcggccagaacggtgacccaaggattccaagccggcagccatcgcttactaccactacccaaggttacttcgacgctcggagagatcgtggctcgaacgctggaacgacagtcacggactcgaaacgtacctcaggagagcatacgccaacagataccaaatctccggaacgttccaagtcgccaccgacggaaaagacaagcaagccaccaaaatatggagaccgaccagtgtggtggctggatatctatagcccgaccgagcaagagatgaaggttatctccaaggcatttggtatccacccactcacagctgaagatatcatgatgcaggaagctcgcgaaaaagttgaacttttccggcactattacttcgtcaattatcgttcattcgaccaagattcagcaagcgagaattttctggagcccgtcaacatgtacgtggtcgtgttccgcgagggcgttctaagcttccacttttcgcaaacaccgcacccggccaacgtgcgtcgacgaattcgtcagctgcgtgactatctcattctctcatcggattggatatcgtacgccattatcgacgacattaccgatgtttttggtccgctgattcacaacatcgaggatgaagtcgacgatatcgacgaagccattttgctactgcactcagaagacgatccgaatttcccaacggataatctcaaagaaaagtctgaggccggcgacgcaacatcggccgaatctggacgcgacatgctcagacgcgtgggcgactgccgcaaaaaggtgatgtcgctttacagactgctcggtaacaaggccgacgtcatcaagagcttcgcaaagcgttgcaacgagcattgggaggtggcgcctcggtcggagatcggtctgtacttgggtgacattcaggatcatattgtgaccatgacttcgaacttgagtcactatgagaaaatcctagcacgatctcatgccaactacctagcgcaaatcaacatacgcatgaacgagcgacaggagcagacggctgacgtgctcgggagactcaccgtcttgggtaccattgtactccccatgaacatcgttaccggtctttggggcatgaacgtctgggtccctgggcaggggaacgagggcgacctcaagtggttcacggccatcacagcgggactgctactttttgggtttggctgttatctgattgcgaagcgtgtgtataagattgtgtaa

SEQ ID NO: 124 - protein, 822 aa, Neurospora crassa
MDLNTPPRHDASASNSGPSAGQPPQNQPSRRRKNHRAGKKKKKNRRTSFGVTSEDMAQERMNDKALAEARNGFYSQPGNNFSNTSIDSEALLDHREQQPFLRPRRPSMLVSQSSHLTTPQVASRLKTVVASSNNSEDEHEGAPLLSSSVFQRSEGFAGYGSNDTARRDSVASRLESSRDSSKRRRATSLGATGTEGYNVNYPPSVPGTPPMGATDRDLSMSFGDIMMRDDVNSMPNSPGRRTLNEESDLVGSLERRHTIALQAEEDVCFPQDGLSEIADEDLRTRDPTAYRMKRRRRGKWPDLAILEEWSRYEKEGRSEERHAKKITEPQLINGRLRPVHRGWYRAQEDAPYRFTYFNEEFQSTIHSQTISELVPPGGSFRQLFIPDPPLLSDSSDDEDDEEDQRHVGLDEVLGGQNGDPRIPSRQPSLTTTTQGYFDARRDRGSNAGTTVTDSKRTSGEHTPTDTKSPERSKSPPTEKTSKPPKYGDRPVWWLDIYSPTEQEMKVISKAFGIHPLTAEDIMMQEAREKVELFRHYYFVNYRSFDQDSASENFLEPVNMYVVVFREGVLSFHFSQTPHPANVRRRIRQLRDYLILSSDWISYAIIDDITDVFGPLIHNIEDEVDDIDEAILLLHSEDDPNFPTDNLKEKSEAGDATSAESGRDMLRRVGDCRKKVMSLYRLLGNKADVIKSFAKRCNEHWEVAPRSEIGLYLGDIQDHIVTMTSNLSHYEKILARSHANYLAQINIRMNERQEQTADVLGRLTVLGTIVLPMNIVTGLWGMNVWVPGQGNEGDLKWFTAITAGLLLFGFGCYLIAKRVYKIV

SEQ ID NO: 125 - DNA, 2100 bp, Neurospora crassa
  CDS (1)..(2100)
atgtttgaccaggaggaaaacgtggggaactccgggtactcaaccccggtgcccgaacttgacgaccaccggaaccaatccgtttctgtccaacgacccgaccgtcctcgacgcggaacattcgattctctatacgggccaggacaggtgattgagacgggcccaacacgcagcgattcgttccagggcacaaggatccgagattttgaggaagctgttgttgacgaggaggatcaggagaactcgccagtttatcggagagatcggcgaggaactgtagagtctgctgtgttagatgttcggtctatctcacccccgaactcggttaaggctttcgcggaagcacgccgaagggagcgagatctctccttctccgagccaacgagacctgagcgtcgagtcgaagagccacccgagctgcagcgggctaactctatcgtcagtcgccgtagctaccgcagcaagcagccgacggtgattgatgacaccgccagcttggccaccaacaaatccgcggaggaagacgtttgcttccccttgcaagatgatcatagggatgacaacttgcatatcgatttccactacttggagacctttatcaaggctgagaatgaagcccgacagtcagctcgccgcccctcggccatccgtgtcttccccgatttgcggcctgccgagcccgatgttacccccaccgtaccaatggtaacactggatggggatatcctttcggccccttcggagacggatattcggcgggaaaagagtcatgagacagacgacgatgccgaggccaaaaggactccaccaccgccacaacctcaggttgaccagagccgggtcagtttcttttcctcagcttgggaatccacgatccacgctgccgacctggagggtttgattttgcccggggaggacattagagggcttttcagtttcccaaagggggagactgatggagtctggtggctcaatatgaacaatccctccgaagaagaagtccgtgccgtctgcagagcttttggcatccaccccttgacaattgaggatatcaccacgcaggaatcccgggagaagattgagcttttcccatcctactatttcgcctcgttcagatcgttcttcattgaggtagaggataccaccggggaaaaggagtacgtgcccttcaacatttacgtggtagtgtttcgcgaaggcacattgagcttcagctacgccaacaattcccatgcctcacatgtgaggaagagaattacgatgctgaaggactatgtctcattgagtagcgattggatttgctacgccctgattgacgacattgtcgattcgttcgctcccgaaatcagcaaacttgagcacgaaaccgaccagatcgaggacgatgtgttcattgctcggtccgacgacatggctcagttcttgaagaagattggcattgctcgcaagaatgtcatgggcttgatgcgcttgctcggcggaaaagcagatgtcctcaggggcttcaccaagcgctgcaacgagaactacaaagtcacgccacgtatggacattggtctatacctcggtgacatccaggaccacgtagtgaccatgatgaccaacctgggccatttcgagaagatgctgtctcgtgcacacagcaactacctcgctcagatttccatcgacggcatcatccagggaactgctacgaaccgtgtcctcagcaagatcaccctgctggcctccatcatcgtcccgctcaacgtggtgactgggaaagggctgccaagcaatgtcgataacatggctgttataacatgggagtgtggcgcaacaatggatattcctcaggccgacctcgatctcctcaacgagaaggacaagaacgagcttcgcggtttcatttccaacgagacgcagcgccagagggtgcaaggacagacccacgcccttaccgattcctgctggaagaaatgcgtcacctcccccatcaagaccaaccagctcgacaagaccgaggccgtctgcatggcggactgcgttgagcgcttcctggacgtcaacctgaccatcatggcccacgtgcaaaagatcaccaggggtggcagcaagtaa

SEQ ID NO: 126 - protein, 699 aa, Neurospora crassa
MFDQEENVGNSGYSTPVPELDDHRNQSVSVQRPDRPRRGTFDSLYGPGQVIETGPTRSDSFQGTRIRDFEEAVVDEEDQENSPVYRRDRRGTVESAVLDVRSISPPNSVKAFAEARRRERDLSFSEPTRPERRVEEPPELQRANSIVSRRSYRSKQPTVIDDTASLATNKSAEEDVCFPLQDDHRDDNLHIDFHYLETFIKAENEARQSARRPSAIRVFPDLRPAEPDVTPTVPMVTLDGDILSAPSETDIRREKSHETDDDAEAKRTPPPPQPQVDQSRVSFFSSAWESTIHAADLEGLILPGEDIRGLFSFPKGETDGVWWLNMNNPSEEEVRAVCRAFGIHPLTIEDITTQESREKIELFPSYYFASFRSFFIEVEDTTGEKEYVPFNIYVVVFREGTLSFSYANNSHASHVRKRITMLKDYVSLSSDWICYALIDDIVDSFAPEISKLEHETDQIEDDVFIARSDDMAQFLKKIGIARKNVMGLMRLLGGKADVLRGFTKRCNENYKVTPRMDIGLYLGDIQDHVVTMMTNLGHFEKMLSRAHSNYLAQISIDGIIQGTATNRVLSKITLLASIIVPLNVVTGKGLPSNVDNMAVITWECGATMDIPQADLDLLNEKDKNELRGFISNETQRQRVQGQTHALTDSCWKKCVTSPIKTNQLDKTEAVCMADCVERFLDVNLTIMAHVQKITRGGSK

SEQ ID NO: 127 - DNA, 1065 bp, Legionella pneumophila
  CDS (1)..(1065)
atgaatactcataaaacaaaggcttcagcaaaagcgggactcttaccggggactgccgtatatataggcgaacacccaccgcaaccaactcaagtaacgatacatatttatgacaaaaaaaattataagcgtttagattccttcgatacccgacaagtgaaagaggcctatgaagctggacataatatttggatagatatttcaggtcttgcagacatcgagaaaattactaaaatttgctcagaatacaacatacaccccttggttatcgaggatttgcttaataccagacaaagacccaaactggatattgtagacgattatatttttgttgtttttaaattattacaatcccctcccgatcacttatcttacaatacagaacagttctgtttaatcatcaagcaaaaacttttactcacattcagagaatctgaaaaatataatttatcttccatttatcaacgccttaatggagagcactcgttaaccagagaatatggaagtgattatttgacctatctgatcatggactatattgttgatgattatttcaactttgtcgaaacttcagcccaactgcttgaaaccttggaagatcaattaattaataaaccagaaacgattaggttacaagcgttatacaccatcaaaagaagaaccattaccctcagaaaaatcattcctcctttgagagatattgtccatttgttgcttacagacgatggggggttaatcaataaaaagtataatctttacttccgggacttatatgatcattgcattcgcctggtagaatcgatcgatttgcatagagaaatgtcggcaagtatgctagacatatacctgtctactataaataatcgcatgaatgaatccatgaaaattctgaccttgtttgccagtatttttattcctttaagttttattgccggggtttatggaatgaattttaaatttatgcctgagctggattggcgatacggttaccctatgattctggttaccatggtacttctggcaatactcatgctgtatttttttaaacgaaaaaaattattttaa

SEQ ID NO: 128 - protein, 354 aa, Legionella pneumophila
MNTHKTKASAKAGLLPGTAVYIGEHPPQPTQVTIHIYDKKNYKRLDSFDTRQVKEAYEAGHNIWIDISGLADIEKITKICSEYNIHPLVIEDLLNTRQRPKLDIVDDYIFVVFKLLQSPPDHLSYNTEQFCLIIKQKLLLTFRESEKYNLSSIYQRLNGEHSLTREYGSDYLTYLIMDYIVDDYFNFVETSAQLLETLEDQLINKPETIRLQALYTIKRRTITLRKIIPPLRDIVHLLLTDDGGLINKKYNLYFRDLYDHCIRLVESIDLHREMSASMLDIYLSTINNRMNESMKILTLFASIFIPLSFIAGVYGMNFKFMPELDWRYGYPMILVTMVLLAILMLYFFKRKKLF

SEQ ID NO: 129 - DNA, 1011 bp, uncultured Acidobacteria bacterium
  CDS (1)..(1011)
atggaaatttttgtttaccggcacggcgccccaaacattgaagaaggcttcaccatcgccgagcttccggcactactcaaagacgagcaggccatcgtctgggtgaacatgaaccaaccgacgaaggttgacgaggacgtgctcctcgatgtttttcagtttcatccattgacggtggaggactgccgcgagaaccgccactatcccaaggtcgaagaattccccagctatctttatctgatcgtacacggcgtgcgggcggatacgagtcccgatcacttcaacacgatcgagctcgacgcgtttctcggtcccaattacgtcatcacttatcaccacgacgagtttcgcagtattgaaaatgtcaagcagctcatacgcactagcccgattgcctgccaacgcggcgccgccttcctgctccatcagatactggatcagattgtcgattattactcgcccgtactcgacgattttgacgagcgtatcgaccaactcgaggcggatattttcactttgaagactcctaacaattcaatcctcgaggagattatggatctgaagcgcggcgtgctgcggctcagaagaatctcagcgaaacaaagagaggtaatgctgcgcatgagccgcggcgagtttcaactgatcgatgcgcagatgctgcccttctatcgcgacgtgcacgatcacatcgtgcgcgtcaccgatctggcggagagttatcgcgatttgatcagcggcacgctcgaggcgtatttgtcagtagtctcaaaccgcatgaacgagatcatgaaagtgctcacgatcttttcggcgatcatgctgccgttaacttttatcgccggcgtttacggcatgaacttcgacaacatgccggagctacactcgcgctacggctattacaccgtttggatcatcatgagcgttgttgctgtgggaatgctgggattgttttggaagcgtggctggatcgggagtgggccgaagaagaggattaaggatgaaggataa

SEQ ID NO: 130 - protein, 336 aa, uncultured Acidobacteria bacterium
MEIFVYRHGAPNIEEGFTIAELPALLKDEQAIVWVNMNQPTKVDEDVLLDVFQFHPLTVEDCRENRHYPKVEEFPSYLYLIVHGVRADTSPDHFNTIELDAFLGPNYVITYHHDEFRSIENVKQLIRTSPIACQRGAAFLLHQILDQIVDYYSPVLDDFDERIDQLEADIFTLKTPNNSILEEIMDLKRGVLRLRRISAKQREVMLRMSRGEFQLIDAQMLPFYRDVHDHIVRVTDLAESYRDLISGTLEAYLSVVSNRMNEIMKVLTIFSAIMLPLTFIAGVYGMNFDNMPELHSRYGYYTVWIIMSVVAVGMLGLFWKRGWIGSGPKKRIKDEG

SEQ ID NO: 131 - DNA, 1095 bp, Rhizobium loti Mesorhizobium loti
  CDS (1)..(1095)
atggcaaaggccgatgcggtgaagaggcgggcgccggcgaagacgaggcggccgcccgtcggcgcctcgccgggcacgctgatcgccgatccggcggcgcggcgcagtgagctcaggctgacgctgatttcgcccgaaaaattcaagaccatcgacaatgccagcatcgatgatctcaatgtccattgcgaccgctggccggtcgtctggctggattgcaccgggctcgccaacatcccgctgatcgaggagatcggccggatcttcaacctgcatccgctggccctggaggatgtcgtcaacaccgaccagcgaccgaaggtcgatttcttcgaggaccacgccttcgtcgtcgtgcgcatgatcgacgatgtcacagctcatcgctacgagcagatcgccgtgttcttcggtaagaatttcgtcgtcactttccaggaacgcgagggagatccgttcgacccggtacgcaagcgtatcgggagttcggcgcccaaccgcctgcgcacacgcggcgccgactatctggcctacgcgctgatcgacgccatcgtcgacagctattttccgccggtcgaggcggccggcgaccaggtcgacggcatcgaggacgagatgctgcattcgacgcacaagcatcagatgcggcaactgcacgaattgcggcgcgacgccaatgtgctgaagggcgtgctgtggccgatgcgcgatgcgctggcgacgctgatccgcaacgacgtgccctatgtcaaagccgagaccaaggttttcctcaatgacacactcgaccattcgctcaggctgatcgagctggttgagacccagcgcgacatgctgaccgggctgatcgagatgcatctgtcgctgagccaggcgcgcaccaacgacgtcatcagctatctcaccatcgtctcggtcatcttcatgccgctcaccttcctggtcggcgtctggggcatgaatttcagtcccgatgcctcgccatggaacatgccggaactgcgatcttactatggttatccggcggcgctcgtcttcatgctgcttgtcgcgatcggcctgattgccttcttcaaatggaaaaaatggctttaa

SEQ ID NO: 132 - protein, 364 aa, Rhizobium loti Mesorhizobium loti
MAKADAVKRRAPAKTRRPPVGASPGTLIADPAARRSELRLTLISPEKFKTIDNASIDDLNVHCDRWPVVWLDCTGLANIPLIEEIGRIFNLHPLALEDVVNTDQRPKVDFFEDHAFVVVRMIDDVTAHRYEQIAVFFGKNFVVTFQEREGDPFDPVRKRIGSSAPNRLRTRGADYLAYALIDAIVDSYFPPVEAAGDQVDGIEDEMLHSTHKHQMRQLHELRRDANVLKGVLWPMRDALATLIRNDVPYVKAETKVFLNDTLDHSLRLIELVETQRDMLTGLIEMHLSLSQARTNDVISYLTIVSVIFMPLTFLVGVWGMNFSPDASPWNMPELRSYYGYPAALVFMLLVAIGLIAFFKWKKWL

SEQ ID NO: 133 - DNA, 1008 bp, Rhizobium loti Mesorhizobium loti
  CDS (1)..(1008)
atggaatatgtccgagagttcaagcccgcggcgccgacatcaggcattatcgcctccagtgtctacacggccgggcggcgtatcgccgacattccgatcgaggaagccggcgaatgggccaagaaatcgggacatgtcgtctggatcgggctgctcgaaccggatcgcgagcttctgttgcgcgtccaggcgcagttccatctgcatgaactggcgatcgaggatgccgagcatccgcaccagcggccgaagatcgagcaatatggcgatgcgctgttcatcgtcgcccgcaccgcgcaattgatcgaaggacgggtgactttcggcgagacgcatctgttcgtcggctcgggctatatcgtcagcgtcaggcatggcccgtcgacctcctacgccgccgtgcgccagcactgggaaagctgtccgcattcgctggccaagggcgaggatttcgtcctctacgccattctcgatttcatcgtcgacaactacatgccagtgctcgagcagatcgaggacgaggtcgaggtgatcgaggacagggtgcttttgaagccgatgaccggtcctgatatcgagcggctctacatgctgcgccgcgatctgctgcgcctgcgcaatgcggcacttccgctggtggaagtctgccgccgcctgaccagcgccgacctgccgcagatccattcggccatgcacccgttgtttcgcgatgtgaccgaccacatccgcaccgtccaggagaagatcgacagtctgcgcgaggtgctggccttcgccttcgaggcgagcctgctggtcggtcagagccaggaaacggcgatttccaagaaactcgcctcctgggcggccatactggccgtgccgacggcgttcgccggcatctacggcatgaacttcaccgacatgccggaactgaagatggaatatggctacccgatcgttctggccaccatcgcgacgatctgcgcgtttctctactggcggttccgcaagaatgggtggctgtaa

SEQ ID NO: 134 - protein, 335 aa, Rhizobium loti Mesorhizobium loti
MEYVREFKPAAPTSGIIASSVYTAGRRIADIPIEEAGEWAKKSGHVVWIGLLEPDRELLLRVQAQFHLHELAIEDAEHPHQRPKIEQYGDALFIVARTAQLIEGRVTFGETHLFVGSGYIVSVRHGPSTSYAAVRQHWESCPHSLAKGEDFVLYAILDFIVDNYMPVLEQIEDEVEVIEDRVLLKPMTGPDIERLYMLRRDLLRLRNAALPLVEVCRRLTSADLPQIHSAMHPLFRDVTDHIRTVQEKIDSLREVLAFAFEASLLVGQSQETAISKKLASWAAILAVPTAFAGIYGMNFTDMPELKMEYGYPIVLATIATICAFLYWRFRKNGWL

SEQ ID NO: 135 - DNA, 972 bp, Ralstonia solanacearum Pseudomonas solanacearum
  CDS (1)..(972)
atgcccatggtgatcaacagcgcgttgtatcgcaacggccggcgcgagcgtgatctgtcggtcgacgccatcagcgatgtgctgcacgcgccgggcaccttcgtctggctgggcctgcacgagccggacgacgccatgctcgcccgcgtgcaggaggaattccacctgcacgacctcgccatcgaagacgcccgcaaggctcaccagcgccccaagctggagacctacggcgacacgctcttcatcgtgctgaacacggcgcagatggagcagggcgaggtggtcttcggcgaaacgcacctgttcgtcgggcgcgacttcctggtctcggtgcggcacgggccgtcgacgtcgtactcgccggtgcgcgagcgctgcgagcacgtgccgcacctgctggccaagggcgcgccgttcgcgctgtacgcggtgatggatttcgtggtcgacaattaccagccggtgctcgaatccatggaggcggcgttcgacgcgatcgagggccagctcttcggcgatgcgttcgaccgtgccgccatcgagcggctgtacacgctcaagcgccagctgctgcgcctgcgcaacgccgcgctgccggtggaggacatcgccggccagctggtgcgcctgcacgaagatgtcgtgcccaaggagctgcgcgcgtacttccgcgacgtggccgaccacgcccaccggctggtcggcgcgctggacgtgatccgcgaaatgctgaccacggcgatctcggtgaacgtggcgctggtgtcggtcacgcagaacgacatcgtcaagcggctggccgggtggggcgcgatcctggcgattccgaccgtggtgttcagcaactacggcatgaacttcaagggcatgcccgagctggagcatccggcggggtatcccatcgtgctggcctgcaccgcggcggcgtgcgtgtggctgtatcgcaagctgcgcaggtcgggctggatctaa

SEQ ID NO: 136 - protein, 323 aa, Ralstonia solanacearum Pseudomonas solanacearum
MPMVINSALYRNGRRERDLSVDAISDVLHAPGTFVWLGLHEPDDAMLARVQEEFHLHDLAIEDARKAHQRPKLETYGDTLFIVLNTAQMEQGEVVFGETHLFVGRDFLVSVRHGPSTSYSPVRERCEHVPHLLAKGAPFALYAVMDFVVDNYQPVLESMEAAFDAIEGQLFGDAFDRAAIERLYTLKRQLLRLRNAALPVEDIAGQLVRLHEDVVPKELRAYFRDVADHAHRLVGALDVIREMLTTAISVNVALVSVTQNDIVKRLAGWGAILAIPTVVFSNYGMNFKGMPELEHPAGYPIVLACTAAACVWLYRKLRRSGWI

SEQ ID NO: 137 - DNA, 1056 bp, Fusobacterium nucleatum subsp nucleatum
  CDS (1)..(1056)
atgccaaactcaaatagaaaattaggtttacttccaggaagtgttgtatacactggagaaaaccctaattataatataactgttactgtaatttattattcaaaaacttttcataaaaaagatgttttttcagctgatgataaaatagatatagacttagaatttgatggaaatatctggataaatatagatggtattaatgatgtaagtcttataaaaagaatagggaaaatatttaatatagattcattatctttggaagatatagctaacccagaacaaagagtaaaaatagatgacagagattcatatattcatataatactaaaaatgttacaaatggagatacttacaaaagatgttcaatatgaacagttatctttaataataaaagataacattttaattactttccaagaaacaccatatgacttatttgaatcaataagaagcaggttagaaaatcctagaacaaaattagcatcaaaggatgttagttacttagcatatatattaatagacaccattgttgataattacttgctagtcttagatgaagttgaaaatgaaatagatgatattgaaaataagctaattgaaagtgctgataaagaagatttagaaaatatcttagctttgaaacaaaatattgctgttttaaaaaaatttatttctccaattagagaattaatttctaagctacaagcaagaagtatgttaaattatttccatgaagatatgaaatactatttaggcgacttaaatgaccatgggattatagtttttgatactgttgatatgcttaacaatagagcaactgaacttattcagttataccattcaatgattagcaataccatgaatgaggtcatgaaaatcttagctattatctcaactatatttatgcccttgagctttattgttggactttatggaatgaattttgaatatatgcctgaacttaaatggcactatgggtattttataactttaggcttaatggcaggacttgttattttaatgattgtttactttaaaaagaaaaaatggttttag

SEQ ID NO: 138 - protein, 351 aa, Fusobacterium nucleatum subsp nucleatum
MPNSNRKLGLLPGSVVYTGENPNYNITVTVIYYSKTFHKKDVFSADDKIDIDLEFDGNIWINIDGINDVSLIKRIGKIFNIDSLSLEDIANPEQRVKIDDRDSYIHIILKMLQMEILTKDVQYEQLSLIIKDNILITFQETPYDLFESIRSRLENPRTKLASKDVSYLAYILIDTIVDNYLLVLDEVENEIDDIENKLIESADKEDLENILALKQNIAVLKKFISPIRELISKLQARSMLNYFHEDMKYYLGDLNDHGIIVFDTVDMLNNRATELIQLYHSMISNTMNEVMKILAIISTIFMPLSFIVGLYGMNFEYMPELKWHYGYFITLGLMAGLVILMIVYFKKKKWF

SEQ ID NO: 139 - DNA, 828 bp, Chlorobium tepidum
  CDS (1)..(828)
atgtccgtcagcgatgccgcagagtgcttcgccctgaaagagaaattcaaagtgctctggatcaatgtcgatggcctgcacgaaactggcgtgatcgaaaagctcggggagctgttcggcatcgatccgctgacgcaggaggacatcctgcacactggccagcgcccgaaggttgaggatttcgaacgctacctcttcctgtcgctccagatgctcgacttcaaccgcgagaccggcgaaatcagccaggaacagctgagcatcgtgctcggccccggctggctcatcacctttcaggaaaagccgggcgacacgttcgacgccctccggcagcggatcggcagcagcaacgccaaagtcagaaagcacgaggccgattttcttgcttacgccctcgtcgattcggttgttgaccactacttctcgatactcgaagagatcgagaaccggatcgatatgctggacgccgacctgatggccaccttcagccaggagaccttcaatgccctcaacgcgctcaagcgggagctgatcatgttccgcaaagcggtctggccgttgcgggagatcatcggcagcgtcgcgagagacgacttcgccgtggtgggggacctggtcgagcactatttccgggatgtgtatgaccacgtcattctcgtgatcgacacggtcgaggtgttccgggagatcgtcaccagcatgcacgaaacctggctggccggcgtcaacaaccggatgaacgaaatcatgaagttcctcaccatgatcgccacgatcttcatgccgctgtcgttcattgccggggtttacggcatgaacttcaaataa

SEQ ID NO: 140 - protein, 275 aa, Chlorobium tepidum
MSVSDAAECFALKEKFKVLWINVDGLHETGVIEKLGELFGIDPLTQEDILHTGQRPKVEDFERYLFLSLQMLDFNRETGEISQEQLSIVLGPGWLITFQEKPGDTFDALRQRIGSSNAKVRKHEADFLAYALVDSVVDHYFSILEEIENRIDMLDADLMATFSQETFNALNALKRELIMFRKAVWPLREIIGSVARDDFAVVGDLVEHYFRDVYDHVILVIDTVEVFREIVTSMHETWLAGVNNRMNEIMKFLTMIATIFMPLSFIAGVYGMNFK

SEQ ID NO: 141 - DNA, 1116 bp, Streptomyces coelicolor
  CDS (1)..(1116)
atgtcgatgatccgtgacctgcgcgccgcggtccgcccgtcccgcgtctcgctgcgcaaggacggcggtgcctacgacaccacccgtgacccggcgacggcctccgccgtcgtcgactgcgccgtctaccacgacggcacccgcgtcgagacggacgtgccgctgaccccgcacacggcgatgcgccaggtgcgtcgcgacggcgggttcgtgtggatcggcctgcacgagcccaccgaggacgagttcgccggtatcgcccgggagttcgggctgcacccgctggccgtggaggacgccgtccaggcccaccagcggcccaagctggagcgctacgacgactccctgttcacggtcttcaagaccgtccactacgtcgaccacgaccagctcaccgccaacagcgaggtcgtcgagaccggcgaggtcatgtgcttcaccggccgggacttcttcatcaccgtccggcacggcgggcagggctcgctgcgtgcgctgcgccgccgcctccaggaggacccggagctgctgctcaagggcccctccgcggtgctgcacgccatcgccgaccacgtcgtcgacggctacatcgcggtcgccgacgcggtgcaggacgacatcgacgaggtcgagacggaggtgttctcgccggggcgcaagggctccccgcgcggcacggacgccgggcggatctaccagctcaagcgcgaggtgctggagttcaagcgggcggtggcgccgctgctgcgtcccatgcagctgctcagcgagcggccgatgcggctggtcgacccggagatccagaagtacttccgggacgtggccgaccacgtggcccgagtgcaggagcaggtcatcgggttcgacgaactgctgaactccattctccaggccaacctcgcccaggcgtccgtggcgcagaacgaggacatgcgcaagatcacctcgtgggccgcgatcatcgccgtacccacgatggtgtgcggggtctacggcatgaacttcgactacatgccggagacgcactggaagttcggctacccgctggtcctgtcggtcacggtctgcatctgtctgggcatccaccgcaccctcaagcgcaacggctggctctaa

SEQ ID NO: 142 - protein, 371 aa, Streptomyces coelicolor
MSMIRDLRAAVRPSRVSLRKDGGAYDTTRDPATASAVVDCAVYHDGTRVETDVPLTPHTAMRQVRRDGGFVWIGLHEPTEDEFAGIAREFGLHPLAVEDAVQAHQRPKLERYDDSLFTVFKTVHYVDHDQLTANSEVVETGEVMCFTGRDFFITVRHGGQGSLRALRRRLQEDPELLLKGPSAVLHAIADHVVDGYIAVADAVQDDIDEVETEVFSPGRKGSPRGTDAGRIYQLKREVLEFKRAVAPLLRPMQLLSERPMRLVDPEIQKYFRDVADHVARVQEQVIGFDELLNSILQANLAQASVAQNEDMRKITSWAAIIAVPTMVCGVYGMNFDYMPETHWKFGYPLVLSVTVCICLGIHRTLKRNGWL

SEQ ID NO: 143 - DNA, 1020 bp, Leptospira interrogans
  CDS (1)..(1020)
atgaaacgaattttattgactgaatactttcccgaaggaagccaagaaaaatcagtggcccatccttgccaaattctccaaaagatagaaaacaaacccaccgaagttccagaattagaatggctttgcaataagggattaatctggatcgatttagattctacggaaagtgaagatatagattttttagccagagaatgtaattttcatccgctcgcaattgaagattgtatcaataaaaatcaaagacctaagttagacgaatacgattcttatctttttattgttctacatcgattccattatgacacagataaaaaaatcctaagaaatagcgagatccacatctttttcaacgaaaaattcgtagttacagttcaccaaaaggaggaacctctgatcgaacaactcagagaacgttgtatgacacaggggaatcctttatctagaggaacggatcagattctttatatgttatttgatcaaacggtagattcaaatttcccaatcctagacaaaatgagcgaagaaatcgtacgaatcgaatctcaaattttagtaaatcaagatagcaatcaaaccatagcaggaattctatttctcaaacgaaacctgactcgaattagaagggtactttctcctcaaagagaaattgtaaacagtctaattcgaagagatcacaattttctaactcctaaaattcaaatttattttcgagacgtatatgatcatctaaatcgactttacgaaacgatcgatatggacagagatctactcggtaatacgatggacgcttatttttcagtaatttctcagagaaccaacgatattgttaaacggcttactcttatcagtttgatttttatgcctcttacattcctaaccggtttttttggaatgaattttaccgcaattccatacgacagtaattcatttttatactttacgatcttatttgcatccatcattcctataggaatgatttactggtttcgaaaaaaacattggtttaaagattaa

SEQ ID NO: 144 - protein, 339 aa, Leptospira interrogans
MKRILLTEYFPEGSQEKSVAHPCQILQKIENKPTEVPELEWLCNKGLIWIDLDSTESEDIDFLARECNFHPLAIEDCINKNQRPKLDEYDSYLFIVLHRFHYDTDKKILRNSEIHIFFNEKFVVTVHQKEEPLIEQLRERCMTQGNPLSRGTDQILYMLFDQTVDSNFPILDKMSEEIVRIESQILVNQDSNQTIAGILFLKRNLTRIRRVLSPQREIVNSLIRRDHNFLTPKIQIYFRDVYDHLNRLYETIDMDRDLLGNTMDAYFSVISQRTNDIVKRLTLISLIFMPLTFLTGFFGMNFTAIPYDSNSFLYFTILFASIIPIGMIYWFRKKHWFKD

SEQ ID NO: 145 - DNA, 972 bp, Pseudomonas putida strain KT2440
  CDS (1)..(972)
atgggtcgagtcgtggcatcggcggtgtacagcgccggcagaaaggtcaccaacatcagcatcgacgaaggcagcgagtgggcgcgcaagccggggcatttcgtgtggatcggcctggaagagcccaatgccgaggagctggccaacctgcagtcgcagttcaacctgcacgaactggccatcgaagatgccctggaaaaacacagccggcccaagctggaaaccttcggtgacgcgttgttcatcgtcacctattcgccagtgcgccacgaaggcaagctggaattcatcgaaacccatatcttcgcgggcaacggctacatcatcacctgccgcaacggccactccaaatcctacgccatggtccgccagcgctgcgaggctcggccgctgctgctggaacatggcgaagacttcgtgctgtacgccctgctcgacttcgtcaccgagaactaccagccggtcagcgaggccattcatggcgagatcgaagcgctggaggaaagcgtactgggcggctcgctgcgggaagacgacatccgccgcctgcacagcctgcgccgtgacatcctgcgcctgcgccgctacgtggcccccctggttgaagtgagcgaagaactgcagcgcctgagcttcccgttcatcgacaagaacatgcgcccgtactttcgtgatgtgcaaattcacgtgacacggcagatggaagacttggccggcatccgcgacattgccagccagacgatcgagatcggcatgctgctggagtcgtcacggcaaagcatcgtgcagcgcaaattcgcggcctgggcggcgattctggcattccctacggcgattgccggggtttacggcatgaacttccagaacatgccggagctgagctggcactacggttacttcgcggtactgggggtgattgcgacggggtgtgccgggttgtatgccagcttcaagaaatcgggttggctttaa

SEQ ID NO: 146 - protein, 323 aa, Pseudomonas putida strain KT2440
MGRVVASAVYSAGRKVTNISIDEGSEWARKPGHFVWIGLEEPNAEELANLQSQFNLHELAIEDALEKHSRPKLETFGDALFIVTYSPVRHEGKLEFIETHIFAGNGYIITCRNGHSKSYAMVRQRCEARPLLLEHGEDFVLYALLDFVTENYQPVSEAIHGEIEALEESVLGGSLREDDIRRLHSLRRDILRLRRYVAPLVEVSEELQRLSFPFIDKNMRPYFRDVQIHVTRQMEDLAGIRDIASQTIEIGMLLESSRQSIVQRKFAAWAAILAFPTAIAGVYGMNFQNMPELSWHYGYFAVLGVIATGCAGLYASFKKSGWL

SEQ ID NO: 147 - DNA, 972 bp, Pseudomonas syringae pv tomato
  CDS (1)..(972)
atgggtcgagttgttgcagcagcggtttacaccaaaggcaaaaaagtccgcgacattacccttgatgaaggcgctgcctgggctgcaaagcccgagcactttgtctggatcgggctggagcaacccagcgccgatgagctgaccagtctcaaagagcagttcaacctgcatgaactggcccttgaagacgcgatggaagttcacagtcgccccaagcttgaaacctttggcgatgcgctgtttatcgtgacctacgcgccggtgcgcgataacggcaaactggtgttcatcgaaacccatatcttcgcgggcaagggttacgtcatcacctcgcgcaatggccattcaaagtcttacgggctggttcgtcagcgctgcgaagcgcggcctttgctgctggaacacggcgaagacttcgtgctttacgcccttctggatttcgtcaccgagaactatcagccggtgaccgaagccattcacaccgagcttgagctgctggagcagagcgtcatcggcggttcactgcgcgagtctgatatccagcatattcatgcactgcgtcgcgacctgttgcgaatgcgccgttacgtggcaccgatggtggaagtgggcgaagaactgcagcgactcagttttccgtttatcgacaagaacatgcgcccctacttccgtgacgtggaaattcacgtgaagcgccagatggaggacctgggcaacctgtgtgacatcgccagccagaccatcgaaataggcctgctgctggagtcctcgcgacaaagcatcgtgcagcgcaagtttgccgggtgggcagccattctggcgttcccgacggcgattgccggcatctacggcatgaacttcgagaacatgcccgagctcaagtggcactacggctacttcatcgtgctgggcgtgatcgttggcggctgtacggcactgtttgccagcttcaagcgctccggctggctataa

SEQ ID NO: 148 - protein, 323 aa, Pseudomonas syringae pv tomato
MGRVVAAAVYTKGKKVRDITLDEGAAWAAKPEHFVWIGLEQPSADELTSLKEQFNLHELALEDAMEVHSRPKLETFGDALFIVTYAPVRDNGKLVFIETHIFAGKGYVITSRNGHSKSYGLVRQRCEARPLLLEHGEDFVLYALLDFVTENYQPVTEAIHTELELLEQSVIGGSLRESDIQHIHALRRDLLRMRRYVAPMVEVGEELQRLSFPFIDKNMRPYFRDVEIHVKRQMEDLGNLCDIASQTIEIGLLLESSRQSIVQRKFAGWAAILAFPTAIAGIYGMNFENMPELKWHYGYFIVLGVIVGGCTALFASFKRSGWL

SEQ ID NO: 149 - DNA, 1161 bp, Streptomyces avermitilis
  CDS (1)..(1161)
atgtccgagcgacgcgcccgcccagcttcgaagaacggcaggaagtccgcctggcgccgggccctgaacccgcccgcgacgccgcccgccgaacctccggcgggcggccccgacgcgccggccccggaaacggcggatgcggccagcgtcgtacaggcgaccctgtaccgcgacggcgtacgcgtctcctcgcccgcctccctcgccgacacgttccgggagctgcgcgacgagccgtccggcatggcctggatcggcctcgcgcgccccacggagtccgaactcctttccctggccgaggagttcgatctgcatccgctcgccgtcgaggacgcgatggaggcacaccagcggccgaaactggagcgctacggcgagacgctcttcgtcgtcctgcgggccgcccgctatctggacgcgccggaggaggtcgacttcggcgaactccatgtcttcgtgggcccggacttcgtgatcacggtccggcacggcgcggcccccgacctgtcggccgtccgccgccgtatggaggagacgccggagctgctgaaactggggccggaggcggtgctgtacgcgatcctggacgcggtggtcgacggctatgtgccggtggtggccggtgtccagaacgacatcgacgagatcgagacggaggtcttccgcggcgacccggccgtctcccgccgcatctacgaactctcccgcgagatggtcgagttccagcgcgccacccgccccctggtcggcatgctgcacagcctgatggcgggcttcgccaagtacggcacggacgaggaactccagcgctacctccgggacgtggccgaccacgtcacccacaccagcgaacgcgtcgacggcttccgccaggcactggcggacatcctgacggtgaacgcgaccctggtcacccagcaacagaacgcggagatgcgggcgttggcggaggcagggttcgagcagaacgaggaaatcaagaagatctcgagctgggcagcgatcctcttcgcccccacgctcgtcggaaccatctatggcatgaacttcgagcacatgcccgagttgggctggagcttcggataccccttcgcgatcggcctgatggggctggtctgcgtcagtttgtacgtgattttcaagcggcggggctggctctaa

SEQ ID NO: 150 - protein, 386 aa, Streptomyces avermitilis
MSERRARPASKNGRKSAWRRALNPPATPPAEPPAGGPDAPAPETADAASVVQATLYRDGVRVSSPASLADTFRELRDEPSGMAWIGLARPTESELLSLAEEFDLHPLAVEDAMEAHQRPKLERYGETLFVVLRAARYLDAPEEVDFGELHVFVGPDFVITVRHGAAPDLSAVRRRMEETPELLKLGPEAVLYAILDAVVDGYVPVVAGVQNDIDEIETEVFRGDPAVSRRIYELSREMVEFQRATRPLVGMLHSLMAGFAKYGTDEELQRYLRDVADHVTHTSERVDGFRQALADILTVNATLVTQQQNAEMRALAEAGFEQNEEIKKISSWAAILFAPTLVGTIYGMNFEHMPELGWSFGYPFAIGLMGLVCVSLYVIFKRRGWL

SEQ ID NO: 151 - DNA, 1116 bp, Streptomyces avermitilis
  CDS (1)..(1116)
atgtcgatgatccgtgacctccgtgccgcggtccgcccgtcccgtccctcgatgcgcaaggacggcagtgcgtacgacaccacgcgtgacccctcgacgccctccgccgtcgtcgactgcgccatctaccgcgacggcgcccgcgtcgcgaccgaccggccgctcaccccgcacgaggcgatgcgccaggtgcggcgcgacgggggcttcgtgtggatcggcctgcatgagccgacggaagccgaattcgccggtatcgcgggcgagttcgggctgcacccgctggccgtcgaggacgccgtccaggcgcaccagcggccgaagctggagcgctacgacgactccctcttcaccgtcttcaagaccatccactacgtggagcacgaccagctgaccgccaacagcgaggtcgtcgagaccggcgaggtcatgtgcttcaccggccgggacttcttcatcaccgtgcggcacggcgggcagggctcgctgcgggcgctgcggcaccggctccaggacgaccccgagctgctcgcgaaggggccctcggcggtgctccacgcgatcgccgaccacgtcgtcgacggctacatcgcggtcgcggacgcggtgcaggacgacatcgacgaggtggagacggaggtgttctcgccgggccggaagggaacgccgcgcggtacggacgcgggccgtatctaccaactcaagcgtgaggtgctggagttcaagcgggcggtctcgccgctgctgaggcccatgcagctgctgagtgagcgaccgatgcgactgatcgacccggacatccagaagtacttccgggacgtggcggaccacctcgcccgggtccaggagcaggtgctgggcttcgacgagctgctcaactcgatcctccaggccaacctcgcgcaggcgtccgtcgcgcagaacgaggacatgcgcaagatcacgtcctgggcggcgatcatcgccgtaccgacgatggtgtgcggggtgtacggcatgaacttcgagcacatgccggagctgcactggcggttcgggtacccggtgatcatgagcgtcaccgtggtgctgtgtctgggcatccaccgcgccctgaagcgcaacggctggctgtaa

SEQ ID NO: 152 - protein, 371 aa, Streptomyces avermitilis
MSMIRDLRAAVRPSRPSMRKDGSAYDTTRDPSTPSAVVDCAIYRDGARVATDRPLTPHEAMRQVRRDGGFVWIGLHEPTEAEFAGIAGEFGLHPLAVEDAVQAHQRPKLERYDDSLFTVFKTIHYVEHDQLTANSEVVETGEVMCFTGRDFFITVRHGGQGSLRALRHRLQDDPELLAKGPSAVLHAIADHVVDGYIAVADAVQDDIDEVETEVFSPGRKGTPRGTDAGRIYQLKREVLEFKRAVSPLLRPMQLLSERPMRLIDPDIQKYFRDVADHLARVQEQVLGFDELLNSILQANLAQASVAQNEDMRKITSWAAIIAVPTMVCGVYGMNFEHMPELHWRFGYPVIMSVTVVLCLGIHRALKRNGWL

SEQ ID NO: 153 - DNA, 1065 bp, Streptomyces avermitilis
  CDS (1)..(1065)
atggcacggctggcgcaacgccgtgcgcgggtcgacctgagtcaccccgccaggtcgcccctgggctccgcggtggtgaactgcgtgatgtatcaggacggcgtacggatgccgggcggtcacgatctggtcgaggccgtggagcgggtccgcaagaaggacgacggcttcgtctggctcgggctgcacgagccgacggaccaggagttcgcgggcatcgccgagctgttcgacctgcatccgctggcggtcgaggacgcggtggaggctcatcagcgcccgaagctggagcggtacggggagacgctgttcgcggtcttcaagacggtctgctacgtcgagcacacggagctgaccgcgacgagtgaggtggtgaacacgggcgagatcatggtgttcatcggccccgccttcgtgatcacggtgcggcacggccggcatggttctctcggccccctgcgcgaggagctggaggccacaccgcagcagctcgccaaggggccggccgcggtgctgcatgcgatcgcggaccatgtcgtcgacgactatctgagcgtcacggacgcggtgcaggaggacatcgaccaggtcgagacggatgtgttcgcggcgagcggtgcgcgggtcgacgcgggacgcatctaccagctcaagcgcgaactcctggaactgaagcgagcggtgatgccactcagccgccccgtacaggagctggccacccggccgatccgagtgatcgaccaggagatacaggcgtacttccgggacgtctccgaccacctgctgcgggtgtccgagcagatcgccgcgttcgacgaactgctcaactcgatcctgcaagcgcatctcgcgcaggtcagcgtcgcgcagaacgaggacatgcggaagatcaccgcgtgggcctcgctcatcgcggtgccgacgatggtgtgcggtgtgtacggcatgaacttcgagttcatgcccgagctgcactggaggttcggctacccgatggtcatggccgtcatagccgtgggctgcgtcactctgtaccggggcttcaagcgcaacgactggctgtaa

SEQ ID NO: 154 - protein, 354 aa, Streptomyces avermitilis; identical to SEQ ID NO: 116

SEQ ID NO: 155 - DNA, 1032 bp, Streptomyces avermitilis
  CDS (1)..(1032)
atgcgcacctgtccgcgcgacggaagaatacgctcagtgatcgtcgattgcgccatctaccgtgacggccgccgcacggagggcccggaggacctctccgacgcccttgacgaggcgcgtgcacagggtgacagcttcctctggatcggcctccacgagccgacggagaaggagttcgacctggtcacccatgagttcggactccatccgctggccgtcgaggacgccctgaaggcgcaccagcggcccaagctggaggtgtacgacgactcgctgttcgtggtcctcaagccggtgacgtacgagccgtacagcgacaccgtctcctcgggcgaggtcatggtcttcgtcggtgactccttcgtggtgaccgtgcgccacggggagggtgcgccgctgtcgagcatccggcacgaactggagcgccggccggacatgctccggcacggtcccaccggggtgctgcacgcgatcgcggactccgtcgtcgaccactatctggacgtggccacggagctggggaccgatctggaggagctggaggcggaggtcttctcgcccagcggcggggcgcggaacacggcgtcgcggatctactcgttcaagcgccagatccaggagttccgccgggccacggttccgctcacgccgccgctgacccggctcgccggcctggggcccaacctcgcggcggtgccgttcgtgaaggaggaggcgcggcccttcttccgcgacgtcaacgaccacctgacgcgcgtcaacgaatccgtggagggcctggaccggctggtctccgacatcctctcggcgcatctcgcgcagatgagcgtgcgtcagaacgacgacatgcggaagatctccgcgtgggcggccatggcggcgatccccacgatgatcgcggggatctacggcatgaacttcgagcacatgccggagctgcactggacgtggtcgtatccggcggtgatcgcggcgatggtggtgctcgaggttctgctgtaccggctgttcaagcagcgggggtggctgtaa

SEQ ID NO: 156 - protein, 343 aa, Streptomyces avermitilis
MRTCPRDGRIRSVIVDCAIYRDGRRTEGPEDLSDALDEARAQGDSFLWIGLHEPTEKEFDLVTHEFGLHPLAVEDALKAHQRPKLEVYDDSLFVVLKPVTYEPYSDTVSSGEVMVFVGDSFVVTVRHGEGAPLSSIRHELERRPDMLRHGPTGVLHAIADSVVDHYLDVATELGTDLEELEAEVFSPSGGARNTASRIYSFKRQIQEFRRATVPLTPPLTRLAGLGPNLAAVPFVKEEARPFFRDVNDHLTRVNESVEGLDRLVSDILSAHLAQMSVRQNDDMRKISAWAAMAAIPTMIAGIYGMNFEHMPELHWTWSYPAVIAAMVVLEVLLYRLFKQRGWL

SEQ ID NO: 157 - DNA, 963 bp, Bacillus anthracis strain Ames
  CDS (1)..(963)
atgggtgaaattatgattagaatttgtgcaataacaaaagcagatgaagtattatatgatgtttcgttagaagaaacaaagaaagaccatattgtatggtattggctagatttatataagccaacgaaagaagagtatacatacattttgcaagaccattttaagttccatccccttgcaattgaagactgtatagaatatgtacagaggccaaaagttgatttttatgatggatataactttttagttcttcatgcatttggtgaggatggattagaaccgcacgagattgatttatttataagtgatcgttatattgtttctttccatttttctcataacaatgcaattgaaagagtatggaaaacacttggagaaaagaagcgtattaaaaacagtcctttacacgtagcgcatacaattatcgatcaaattgtagatgactattttgcacctgtatattacattgaggatcatttaaatgcaattgatgataatttaacgggtgagacggcaggaagtgtactagaagaagtatttgatatacgtgcagatttatcaaagctaaggcgtacaatcattccgatgcgtgatttattgtatcgtattttaaattcaacccgtttttacggtataagtgatcatgaaatttactttaaagatatacatgatcatttgcttaaactgacagaaatgattgaagcaagccgggagttaacagcagatattcgagatagctatttttcattaaactcgcatcatatgaataacattatgaaaacattaacggtattctcgactattttcatgccattaacatttattgcgggagtatacggaatgaactttgagcatatgccagagcttggtggacaatatagttattttatttgtttacttatcatggctttaattggcggtggcatgatggtttggttttataaaaaaggatggtttaagtaa

SEQ ID NO: 158 - protein, 320 aa, Bacillus anthracis strain Ames
MGEIMIRICAITKADEVLYDVSLEETKKDHIVWYWLDLYKPTKEEYTYILQDHFKFHPLAIEDCIEYVQRPKVDFYDGYNFLVLHAFGEDGLEPHEIDLFISDRYIVSFHFSHNNAIERVWKTLGEKKRIKNSPLHVAHTIIDQIVDDYFAPVYYIEDHLNAIDDNLTGETAGSVLEEVFDIRADLSKLRRTIIPMRDLLYRILNSTRFYGISDHEIYFKDIHDHLLKLTEMIEASRELTADIRDSYFSLNSHHMNNIMKTLTVFSTIFMPLTFIAGVYGMNFEHMPELGGQYSYFICLLIMALIGGGMMVWFYKKGWFK

SEQ ID NO: 159 - DNA, 951 bp, Bacillus cereus strain ATCC 14579 DSM 31
  CDS (1)..(951)
atgattagaatttgtgcagtaacaaaaacagatgaagtattatatgatgtttctttagaagaaacaaagaaagaccatattgtatggtattggctagatttatataagccaacgaaagaagagtatacatatattctgcaagaccattttaagttccatccccttgcaattgaagactgtctagaatacgtacagaggccaaaagttgatttttatgatggatataactttttagttcttcacgcgtttggagaagatgggctagaaccacatgaaattgatttgtttgttagtgatcgctatattgtttctttccatttttctcataataatgcaattgaaagagtatggaaaacacttggtgagaagaggcggattaagaaaggacctttacatgtagcacatacgatcactgatcaaattgtagatgattatttcgcacctgtatattacattgaagatcatttaaatgcgattgatgataatttaacaggtgagacagcaggagccgtactagaagaagtatttgatattagggcagatttatctaagttaagacgtacaattattccaatgcgtgatttattgtatcgtattttgaattccactcgtttttacggtataagtgatcatgagatttattttaaagatatacatgatcatttacttaaacttacggaaatgattgaggcaagtcgagagttaacggcggatattcgggatagttatttttcattaaactcacatcatatgaataacattatgaaaacattacctgtattctcgactattttcatgccattaacatttattgcgggagtatatggaatgaactttacgcatatgccagagcttggtggacaatatagttattttatttgtcttcttctaatggcattaattggcggcggaatgatggcctggttttataaaaaaggatggtttaagtaa

SEQ ID NO: 160 - protein, 316 aa, Bacillus cereus strain ATCC 14579 DSM 31
MIRICAVTKTDEVLYDVSLEETKKDHIVWYWLDLYKPTKEEYTYILQDHFKFHPLAIEDCLEYVQRPKVDFYDGYNFLVLHAFGEDGLEPHEIDLFVSDRYIVSFHFSHNNAIERVWKTLGEKRRIKKGPLHVAHTITDQIVDDYFAPVYYIEDHLNAIDDNLTGETAGAVLEEVFDIRADLSKLRRTIIPMRDLLYRILNSTRFYGISDHEIYFKDIHDHLLKLTEMIEASRELTADIRDSYFSLNSHHMNNIMKTLPVFSTIFMPLTFIAGVYGMNFTHMPELGGQYSYFICLLLMALIGGGMMAWFYKKGWFK

SEQ ID NO: 161 - DNA, 1098 bp, Rhodopirellula baltica
  CDS (1)..(1098)
atgcgtcttcgtgtgcaccggccgcggtgggctcgttcacgatccaagattggaaacgttcccggggatctgtcgagcgatgtttcgacgaaaaagaaagacaccgttcccagccacattcgtgtcatccagtacgacggacgaacgcacaccaacgaagtcgtcgaatcgatcgataacgaggactcggacaatccagacatcgtgacctggatcgatttgcatggcatccgtgacatggaggcactgcgttcgcttgggcgacgattcggtttgcacccactcgcgttggaagacgtggtgcagatggatcaacatgcaaaaatggaacgctacggcgagacgttgttttttatcgccaggatgccggttggcgacaatggttttcagaccgaacaagtcagcattttcttggtcggcaacaccgtcatcaccattcaggagaaggtcggggattgcctcgatcccgttcgcgatcgaatttcgcgggcaatgggacgtattcgagatcgcggggcggactacctggtctacgccgttatcgatgcaatcatcgatggctatttcccgatcattgatcgttacgaaagccatttgtctgagatggcggaattgcttcaggatgcggacaacgacaatcttccgatgcatttgcaccacatacgggcggacttgttgtcgattcgaaagacggttcagcaacaccgagacgcgttgcggttgttgctgcgggaaggtgacggcattttggccaatgacacgcgtttgtatctccgagattgccaggaccatatcgggcaattgatggaagcagcggacaccgaccgcgagacatgcggcgaattgcgagagctgtattttgcgttgttggggcaaaaaaataatgacgtgatgaaagtgctcacgatcatcgcaacgcttttcatcccaatgagttttgtcgctgggatctatgggatgaacttcgaccagaaagcatcgcccctgaatatgcccgaactggaatggagttttggttacccgttcgctctttcagtgatgatggttttggcattgagtctgctgtacttcttgtaccgcaagggatggttgtggtaa

SEQ ID NO: 162 - protein, 365 aa, Rhodopirellula baltica
MRLRVHRPRWARSRSKIGNVPGDLSSDVSTKKKDTVPSHIRVIQYDGRTHTNEVVESIDNEDSDNPDIVTWIDLHGIRDMEALRSLGRRFGLHPLALEDVVQMDQHAKMERYGETLFFIARMPVGDNGFQTEQVSIFLVGNTVITIQEKVGDCLDPVRDRISRAMGRIRDRGADYLVYAVIDAIIDGYFPIIDRYESHLSEMAELLQDADNDNLPMHLHHIRADLLSIRKTVQQHRDALRLLLREGDGILANDTRLYLRDCQDHIGQLMEAADTDRETCGELRELYFALLGQKNNDVMKVLTIIATLFIPMSFVAGIYGMNFDQKASPLNMPELEWSFGYPFALSVMMVLALSLLYFLYRKGWLW

SEQ ID NO: 163 - DNA, 1101 bp, Mycobacterium bovis
  CDS (1)..(1101)
atgttcccagggtttgacgcattgcccgaagtgctgcgaccggtcgcgcgaccccagccgccgaacgcacaccccgttgcccagccaccggcccaagccttggtcgactgcggtgtctacgtctgcggccagcgactgcccggcaagtacacctacgccgccgcgctgcgcgaggtgcgcgagatcgaactgaccgggcaggaggcgttcgtctggatcgggctgcacgagcccgatgaaaaccagatgcaggacgtagcagacgttttcgggttgcacccgttagccgttgaggacgccgtgcacgcgcaccagcgacccaagttggagcgctacgacgagacgctgttcctcgtcctcaagaccgtcaactacgtcccgcacgaatcggtggtactggcccgcgagatcgtcgaaaccggcgagatcatgatcttcgtcggcaaggatttcgtggtcaccgtccgccacggcgaacacggcgggttatccgaggtgcgtaagcggatggatgccgaccccgaacatttgcggttgggaccgtatgcggtgatgcacgcgatcgccgactacgtggtcgaccgctacctcgaggtgaccaatctcatggagaccgatatcgacagcatcgaggaagtagcgttcgcgccgggccgcaagctcgacatcgaaccgatctatctgctcaagcgggaagtggtcgagttgcgccggtgcgtgaatccgctatcgaccgcattccagcgcatgcagaccgagagcaaagacctcatttcgaaagaagtgcggcgctacctgcgcgacgtcgccgaccaccagaccgaggccgccgaccagatcgccagctacgacgacatgctcaactcgctggtgcaggccgcgctcgcccgggtcggcatgcagcaaaacatggacatgcgcaagatatccgcgtgggcaggtatcatcgcggtccccaccatgatcgcgggcatctatggcatgaactttcacttcatgcccgagctggactccaggtggggttacccgacagtgatcggcgggatggtccttatctgtctgttcctctaccacgtcttccgcaacagaaactggctctaa

SEQ ID NO: 164 - protein, 366 aa, Mycobacterium bovis
MFPGFDALPEVLRPVARPQPPNAHPVAQPPAQALVDCGVYVCGQRLPGKYTYAAALREVREIELTGQEAFVWIGLHEPDENQMQDVADVFGLHPLAVEDAVHAHQRPKLERYDETLFLVLKTVNYVPHESVVLAREIVETGEIMIFVGKDFVVTVRHGEHGGLSEVRKRMDADPEHLRLGPYAVMHAIADYVVDRYLEVTNLMETDIDSIEEVAFAPGRKLDIEPIYLLKREVVELRRCVNPLSTAFQRMQTESKDLISKEVRRYLRDVADHQTEAADQIASYDDMLNSLVQAALARVGMQQNMDMRKISAWAGIIAVPTMIAGIYGMNFHFMPELDSRWGYPTVIGGMVLICLFLYHVFRNRNWL

SEQ ID NO: 165 - DNA, 1038 bp, Chromobacterium violaceum
  CDS (1)..(1038)
atgccgacgctgggggagcaggcgggaacgctgctgtcggtgggcgatgccaagcacgccggcaccgcgctgtcgctgttcgacttcgggccggaggacatggcggaggtggccgacttcccgatcgccgacctggccgcctaccgcctgcgcggcgaggtgatgtggctcaatgtctacggcctgagcgacgccgccgccatccaggcgataggcgaacgcttcggcctgcacccgctggtgcaggaggacatcctcaacgcccgccagcggcccaagctggaagattacgacgactacctgttcctggcctgccgcgtgttcgattaccagcagggcgcgcggctgcagtccgaccagatgtacctggtgctgggcgacggcttcgtgctcaccttccaggaaaagcccaccggcgtgttcgagcaggtgcgggagcggctgcgcaaggggcgcggcgcgttgcggcggcgcggcgccgactacctggcctattcgctgctggacgccatcatcgacgactacttcggcgtgctcggccagttcaacgacaaggtggagcgcgcagacggccagttgctggccggccgcgacaacggcgtgctgcggcaaatccagcggctgaagcgcgattgcctgaagctcaggcgggcgctgctgccgctgcgcgaggcgctgctgtcgctgaaccgtggagatgacgagcgctttggcgacgatacccgcgtttacctgcgcgacgcttacgaccacgtggtccacgtgctggagtcgctggagatgaaccgcgagatggtcggcgacatgatggacctctacctgtccacccaatcgcaccggctcaacctgcagatgcgggtgctgaccgtgatcacgatgatcttcatgccgctgacgctgatcgccggcatctacggcatgaatttcgagaacatgccggagctgaagtggcactacggctactacatcgtgctgctggcgatgggcggcatttccgccggcatgggttggtggttctggaagcggcgctggatctga

SEQ ID NO: 166 - protein, 345 aa, Chromobacterium violaceum
MPTLGEQAGTLLSVGDAKHAGTALSLFDFGPEDMAEVADFPIADLAAYRLRGEVMWLNVYGLSDAAAIQAIGERFGLHPLVQEDILNARQRPKLEDYDDYLFLACRVFDYQQGARLQSDQMYLVLGDGFVLTFQEKPTGVFEQVRERLRKGRGALRRRGADYLAYSLLDAIIDDYFGVLGQFNDKVERADGQLLAGRDNGVLRQIQRLKRDCLKLRRALLPLREALLSLNRGDDERFGDDTRVYLRDAYDHVVHVLESLEMNREMVGDMMDLYLSTQSHRLNLQMRVLTVITMIFMPLTLIAGIYGMNFENMPELKWHYGYYIVLLAMGGISAGMGWWFWKRRWI

SEQ ID NO: 167 - DNA, 1158 bp, Gloeobacter violaceus
  CDS (1)..(1158)
atgcgagaccggaagccggaagccggagaagcaatgggttccgacgaggatgagtcctacgtcgattaccattacgacgaccccggtaccatgccgggaacgctcagcatcgacaaaaacgctccaccgcccgagatccacctcatcgattacgatgccgaacaatccaccggccgcagggtggaaaatcccgaggaactgacgccttacctggacaaccactcggtctcgtgggccgacgtgcgcggcttcggcagcgaggacatcctgcgccgcctgggcaaggtattcgggctgcatccgctggtgctcgaagatatcgtgaatgtgccccagcgccccaaggtggaagaatacaaggatcacttgctgattatcgccaggatggtctgtcccacctccgaaacagcagaagaatttttcagcgaacaggtgagtttgatcctgggcaaaaactatttgctcacggtccaggaagaagccaaattcgacgtcttcggccccgtgcgcgagcgcatccgcaccgccaagggcatcatctgcaatcagcgcgccgactacctggcctacacgctgctcgatgcgatcatcgacggcttttacccggtgctcgaagacttcggcgaacgcctcgaggaactcgaagcggaggtggtagaaaaccccacccgcgctacccttgagagaatctatctgctccggcgcgaactgctcatgctgcggcgcgccatctggccccagcgcgatgtgatcaacgccctcatccgcgatgccaacccgctgattggcgaggaggtgcgcctctacttgcgcgactgctacgaccacgccatccagatcatcgatatggtggagacataccgggaactggcttcgagcctgaccgacatctacatgtcctcggtgagcaaccgtatgaacgaggtgatgaagaccctcacggtgatctcggccatttttattccgctgacctttatcgccggggtttacggcatgaacttcgatcccgaaaaatccccctggaacatgcccgaactggaatggtactggggctatccgttcagcctggtgctgatgttcatagtggccgtgggtctggtcgtctatttttggcggcggggctggtttgagagcttctcctcgcagagcaaaaagtaa

SEQ ID NO: 168 - protein, 385 aa, Gloeobacter violaceus
MRDRKPEAGEAMGSDEDESYVDYHYDDPGTMPGTLSIDKNAPPPEIHLIDYDAEQSTGRRVENPEELTPYLDNHSVSWADVRGFGSEDILRRLGKVFGLHPLVLEDIVNVPQRPKVEEYKDHLLIIARMVCPTSETAEEFFSEQVSLILGKNYLLTVQEEAKFDVFGPVRERIRTAKGIICNQRADYLAYTLLDAIIDGFYPVLEDFGERLEELEAEVVENPTRATLERIYLLRRELLMLRRAIWPQRDVINALIRDANPLIGEEVRLYLRDCYDHAIQIIDMVETYRELASSLTDIYMSSVSNRMNEVMKTLTVISAIFIPLTFIAGVYGMNFDPEKSPWNMPELEWYWGYPFSLVLMFIVAVGLVVYFWRRGWFESFSSQSKK

SEQ ID NO: 169 - DNA, 1065 bp, Geobacter sulfurreducens
  CDS (1)..(1065)
atgaaaaaaatcatcaagcaacgttcccgcaagacaggccttcctcccggcagtctggtccacatcggcgagcagaccggcgaaccggtccggatatcccttgtcgactacgacgaaacgagcatcagcgagcgggaaacggacgacattgccgagtgttttccccatagcgaccagccgggggtgcggtggctcgacatggagggtatccaccggcccgaactgctcaagacactcggcgaatgctacggtatccaccccctcaccctcgaagacatcctcaataccgaccagcgccccaaactggaggacttcgacgactatctcttcgtggtcctgaagatgctctccctccagccggatggctcgcttaccgcggaacaggtcagcttcgtgctcggcccctcgtttctcatctccttccaggaaggattcaagggagacctcttcgactccatccgccggcgcctgagggaaaaccggggcaagcttcgcaagagcgggtccgactttctgctctactcactcatggacgccattgtggactactacttcgtgatcctcgaagatctggccgagcggatcgaggaactggaagaagaagtcatcgccggccccagccgcaagacggtcgtgaagatccagcacctcaagcgggaaaccatctttctgcgcaaatccgtctggcccctgcgagaggtgctgggacggctggagcggcgcgaatcgcccctggtgcgcggcgaaaccgtcatctacctgcgggacgtctacgaccactgcatccagatcatcgaaaccgtggagaccttccgggacctcctgtcggagatcctcgacatctacctctccgccatcggcaaccggaccaacgaagtgatgaaggtgctcaccatcatcgccaccatcttcatgccgctcaccttcatcgccggggtctatggcatgaacttccgctacatgcccgagctcgaatggcactggggctacccggccgttctcctgctgatgctcctggtaagcctgggtatgggaatattcttccggcgcaagagatggctgtaa

SEQ ID NO: 170 - protein, 354 aa, Geobacter sulfurreducens
MKKIIKQRSRKTGLPPGSLVHIGEQTGEPVRISLVDYDETSISERETDDIAECFPHSDQPGVRWLDMEGIHRPELLKTLGECYGIHPLTLEDILNTDQRPKLEDFDDYLFVVLKMLSLQPDGSLTAEQVSFVLGPSFLISFQEGFKGDLFDSIRRRLRENRGKLRKSGSDFLLYSLMDAIVDYYFVILEDLAERIEELEEEVIAGPSRKTVVKIQHLKRETIFLRKSVWPLREVLGRLERRESPLVRGETVIYLRDVYDHCIQIIETVETFRDLLSEILDIYLSAIGNRTNEVMKVLTIIATIFMPLTFIAGVYGMNFRYMPELEWHWGYPAVLLLMLLVSLGMGIFFRRKRWL

SEQ ID NO: 171 - protein, 1209 aa, Artificial
  consensus sequence
  misc_feature (1)..(558): Xaa can be any naturally occurring amino acid
  misc_feature (560)..(577): Xaa can be any naturally occurring amino acid
  misc_feature (579)..(580): Xaa can be any naturally occurring amino acid
  misc_feature (584)..(585): Xaa can be any naturally occurring amino acid
  misc_feature (588)..(593): Xaa can be any naturally occurring amino acid
  misc_feature (595)..(595): Xaa can be any naturally occurring amino acid
  misc_feature (597)..(597): Xaa can be any naturally occurring amino acid
  misc_feature (599)..(779): Xaa can be any naturally occurring amino acid
  misc_feature (781)..(783): Xaa can be any naturally occurring amino acid
  misc_feature (785)..(1017): Xaa can be any naturally occurring amino acid
  misc_feature (1019)..(1020): Xaa can be any naturally occurring amino acid
  misc_feature (1022)..(1023): Xaa can be any naturally occurring amino acid
  misc_feature (1026)..(1081): Xaa can be any naturally occurring amino acid
  misc_feature (1083)..(1090): Xaa can be any naturally occurring amino acid
  misc_feature (1092)..(1093): Xaa can be any naturally occurring amino acid
  misc_feature (1098)..(1137): Xaa can be any naturally occurring amino acid
  misc_feature (1139)..(1209): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXFXXHPLXXEDXXXXXXRXKXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXDXXDHXXXXXXXXXXXXXXXXXXXXXXXXXXXXXXXXXXXXXXXXXXXXXXXXXXXXXXXXIXXXXXXXXGXXGMNFXXXXXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXX

SEQ ID NO: 172 - DNA, 264 bp, Saccharomyces cerevisiae
  CDS (1)..(264)
atggaaaacgataagggccaattagtcgaactttacgttccaagaaaatgttctgctaccaacagaatcatcaaggctgatgaccacgcatctgttcaaatcaacgtcgctaaggttgatgaagaaggacgtgctatcccaggtgagtacgttacctacgctttgtccggttacgttagatccagaggtgaatctgatgattctttgaaccgtttggctcaaaacgatggtttgttaaagaacgtctggtcttactcacgttaa

SEQ ID NO: 173 - protein, 87 aa, Saccharomyces cerevisiae
  CDS (1)..(87)
MENDKGQLVELYVPRKCSATNRIIKADDHASVQINVAKVDEEGRAIPGEYVTYALSGYVRSRGESDDSLNRLAQNDGLLKNVWSYSR

SEQ ID NO: 174 - DNA, 25 bp, Primer
atggaaaacgataagggccaattag

SEQ ID NO: 175 - DNA, 24 bp, Primer
ttaacgtgagtaagaccagacgtt

SEQ ID NO: 176 - DNA, 252 bp, Rattus norvegicus (Norway rat)
  CDS (1)..(252)
atgcagaacgacgccggcgagtttgtggacctgtacgtgccgcggaaatgctccgcgagcaaccgcatcattgctgccaaggaccacgcgtccatccagatgaatgtggccgaggttgacaggagtacaggccgatttaatggtcagtttaaaacctacggcatctgcggggccattcgcaggatgggcgagtcagatgattctattctccgattggctaaggctgatggaattgtctcaaagaacttttaa

SEQ ID NO: 177 - protein, 83 aa, Rattus norvegicus (Norway rat)
MQNDAGEFVDLYVPRKCSASNRIIAAKDHASIQMNVAEVDRSTGRFNGQFKTYGICGAIRRMGESDDSILRLAKADGIVSKNF

SEQ ID NO: 178 - DNA, 264 bp, Schizosaccharomyces pombe
  CDS (1)..(264)
atggaaaacgaggctggacaattggttgacctttacgtccctcgcaagtgctctgccactaaccgcatcatccaagccaaagatcacgcttctgtgcaaatcaacgtttgcgctgttgacgctgaaggtcgccaaattcctggcgagaagaccacctatgctattagtggctttgttcgctccaagggcgagtccgatgactgcattaaccgccttaccacccaagacggattgttggagggtgtctggtcttatcaacgttaa

SEQ ID NO: 179 - protein, 87 aa, Schizosaccharomyces pombe
MENEAGQLVDLYVPRKCSATNRIIQAKDHASVQINVCAVDAEGRQIPGEKTTYAISGFVRSKGESDDCINRLTTQDGLLEGVWSYQR

SEQ ID NO: 180 - DNA, 252 bp, Homo sapiens (man)
  CDS (1)..(252)
atgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttaa

SEQ ID NO: 181 - protein, 83 aa, Homo sapiens (man)
MQNDAGEFVDLYVPRKCSASNRIIGAKDHASIQMNVAEVDKVTGRFNGQFKTYAICGAIRRMGESDDSILRLAKADGIVSKNF

SEQ ID NO: 182 - DNA, 294 bp, Homo sapiens (man)
  CDS (1)..(294)
atgcagaacgacgccggcgagttcgtggacctgtacgtgccgcggaaatgctccgctagcaatcgcatcatcggtgccaaggaccacgcatccatccagatgaacgtggccaggttgacaaggtcacaggcaggtttaatggccagtttaaaacttatgctatctgcggggccattcgtaggatgggtgagtcagatgattccattctccgattggccaaggcgatggcatcgtctcaaagaacttttgactggagagaatcacagatgtggaatatttgtcataaataaataa

SEQ ID NO: 183 - protein, 97 aa, Homo sapiens (man)
MQNDAGEFVDLYVPRKCSASNRIIGAKDHASIQMNVARLTRSQAGLMASLKLMLSAGPFVGWVSQMIPFSDWPRRWHRLKELLTGENHRCGIFVINK

SEQ ID NO: 184 - DNA, 246 bp, Zea mays (maize)
  CDS (1)..(246)
atgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtccgtgctcagggtgatgctgacagttcgttggacaggctgtggcagaagaagaaggctgagatcaagcagtag

SEQ ID NO: 185 - protein, 81 aa, Zea mays (maize)
MQNEEGKTVDLYVPRKCSATNRIITAKDHASVQINIGHLDANGLYDGHFTTFALSGFVRAQGDADSSLDRLWQKKKAEIKQ

SEQ ID NO: 186 - DNA, 264 bp, Schizosaccharomyces pombe; identical to SEQ ID NO: 178
  CDS (1)..(264)

SEQ ID NO: 187 - protein, 87 aa, Schizosaccharomyces pombe; identical to SEQ ID NO: 179

SEQ ID NO: 188 - DNA, 249 bp, nucleomorph Guillardia theta
  CDS (1)..(249)
atgaattctaccaacaaaaaaattgtaggggaatatatcccgagaaaatgctctttaagtaataaactaatcaataataaagatcatgcttcaattcaaatttcaattggggtcttagataaaaacgatttatttaaaggtgaatatgatatatttgcattttcaggtcttatgagaaaaaaaggtaaatctgattatgcaatagtaaatttaattgaaaaattggataattgtaatttaaaaatttaa

SEQ ID NO: 189 - protein, 82 aa, nucleomorph Guillardia theta
MNSTNKKIVGEYIPRKCSLSNKLINNKDHASIQISIGVLDKNDLFKGEYDIFAFSGLMRKKGKSDYAIVNLIEKLDNCNLKI

SEQ ID NO: 190 - DNA, 201 bp, Homo sapiens Human
  CDS (1)..(201)
atgcagaacgacgccggcgagttcgtggacctgtacgtgccgcggaaatgctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtaa

SEQ ID NO: 191 - protein, 66 aa, Homo sapiens Human
MQNDAGEFVDLYVPRKCSASNRIIGAKDHASIQMNVAEVSWEPGRREGCDICAGKAGCPIVEEPLG

SEQ ID NO: 192 - DNA, 273 bp, Homo sapiens Human
  CDS (1)..(273)
atgcagaacgacgccggcgagttcgtggacctgtacgtgccgcggaaatgctccgctagcaatcgcatcatcggtgccaaggaccacgcatccatccaaatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtaa

SEQ ID NO: 193 - protein, 90 aa, Homo sapiens Human
MQNDAGEFVDLYVPRKCSASNRIIGAKDHASIQMNVAEVDKVTGRFNGQFKTYAICGAIRRMVSVSLGFAHHFGTSWTLPCALECVMVPE

SEQ ID NO: 194 - DNA, 252 bp, Drosophila melanogaster Fruit fly
  CDS (1)..(252)
atggagaacgacgccggtgagaatgttgatctgtacgtgccccgcaaatgctcggcgtccaacaggatcatccacgccaaggatcacgcctccgtgcagctgagcatcgtggatgtggaccccgagaccggtcgccagaccgacggttccaagacctacgccatctgcggcgagatccgtcgcatgggcgagtccgacgactgcatcgtgcgtctggccaagaaggacggcatcattaccaagaacttctaa

SEQ ID NO: 195 - protein, 83 aa, Drosophila melanogaster Fruit fly [sequence omitted]

SEQ ID NO: 196 - DNA, 252 bp, Spodoptera frugiperda Fall armyworm
  CDS (1)..(252)
atgcagaacgacgccggagaattcgttgacttgtactgcccgaggaagtgctcggccagcaaccgtctgatccacgccaaggaccacgcgtccgtgcagctggtgatcgcggacgtggaccccgccacgggccgcgccgccgacacctccaagatgtacgtggtgtgcggagccatccgccgcatgggggagtccgacgactgcatcgtcaggctcaccaagaaggacggcatattggctaagaactactaa

SEQ ID NO: 197 - protein, 83 aa, Spodoptera frugiperda Fall armyworm
MQNDAGEFVDLYCPRKCSASNRLIHAKDHASVQLVIADVDPATGRAADTSKMYVVCGAIRRMGESDDCIVRLTKKDGILAKNY

SEQ ID NO: 198 - DNA, 249 bp, Plasmodium falciparum isolate 3D7
  CDS (1)..(249)
atgtttaacgatcaaaaagttttagtcgatatttatatacccaggaagtgctcagctacatcacgacttattccggccaaggaacatggagctgtacaaataaatgttggaatggttgatgctaatggagtttacaacggtaaaaccgaaaccttcgctatctctggtcatgtcagacaaaatggagaatcagatgcttgcttaaatagacttatgtatgaaaagaaattattatcctttcaaaactaa

SEQ ID NO: 199 - protein, 82 aa, Plasmodium falciparum isolate 3D7
MFNDQKVLVDIYIPRKCSATSRLIPAKEHGAVQINVGMVDANGVYNGKTETFAISGHVRQNGESDACLNRLMYEKKLLSFQN

SEQ ID NO: 200 - DNA, 252 bp, Ceratitis capitata Mediterranean fruit fly
  CDS (1)..(252)
atggagaacgacgccggtgaatctgttgatttgtactgcccacgtaaatgttctgcatccaacagaattatccacgctaaggatcatgcttcagtgcaattaaacattgttgatgttgaccctgaaaccggccgtatgactgttggttcaaagacctacgctatctgcggtgagatccgtcgtatgggcgaatccgatgattgtattgtgcgtttggccaagaaagatggtttgatcaccaaggctttctaa

SEQ ID NO: 201 - protein, 83 aa, Ceratitis capitata Mediterranean fruit fly
MENDAGESVDLYCPRKCSASNRIIHAKDHASVQLNIVDVDPETGRMTVGSKTYAICGEIRRMGESDDCIVRLAKKDGLITKAF

SEQ ID NO: 202 - DNA, 258 bp, Branchiostoma belcheri tsingtaunese
  CDS (1)..(258)
atgcagaacgacgcaggtgaagttgtggatctgtacatccctcgcaagtgctcatcaaccaaccgcatcattggtgccaaggatcatgcctcaatccagatcaactttgctgaggttgacccgaccactggccgcatgacaggacagtacaagacttacgccatctgtggctacatcaggcaaatgggagagtccgatgactgtctgaagcgcctggcaataaaggataaaatcattgacgcaaaaatggatgcctaa

SEQ ID NO: 203 - protein, 85 aa, Branchiostoma belcheri tsingtaunese
MQNDAGEVVDLYIPRKCSSTNRIIGAKDHASIQINFAEVDPTTGRMTGQYKTYAICGYIRQMGESDDCLKRLAIKDKIIDAKMDA

SEQ ID NO: 204 - DNA, 270 bp, Giardia lamblia ATCC 50803
  CDS (1)..(270)
atgcaatcggatgacatcgggatgaagaacagcagcggagtggtcgtagacgcatacataccgcgcaagtgttcagcaacaaataggctcattggcccgaaggaccacgccgcagtccagctgagcgtcgccagggttaatgataagggcaagatgatcgagaacaactatgttacattcgccttctgcggggccatccgcagccgaggcggagtggactcggccttcatgctcctcgcccaggagcacggtctcatggaacgcctttag

SEQ ID NO: 205 - protein, 89 aa, Giardia lamblia ATCC 50803
MQSDDIGMKNSSGVVVDAYIPRKCSATNRLIGPKDHAAVQLSVARVNDKGKMIENNYVTFAFCGAIRSRGGVDSAFMLLAQEHGLMERL

SEQ ID NO: 206 - DNA, 243 bp, Anopheles gambiae str PEST
  CDS (1)..(243)
atggagaacgatgctggagagtttgttgatctgtactgcccccgcaagtgctcttcgagcaaccgcatcatccacgctaaggatcatgcctccatccagatcaacatcgtcgacgtagacccggagactggccgcatgctggacacctccaaggtgtacgccatctgcggtgagatccgccgtatgggcgaatcggacgattgcatcgttcgtctggccaagaaggacggtatcctgtcctaa

SEQ ID NO: 207 - protein, 80 aa, Anopheles gambiae str PEST
MENDAGEFVDLYCPRKCSSSNRIIHAKDHASIQINIVDVDPETGRMLDTSKVYAICGEIRRMGESDDCIVRLAKKDGILS

SEQ ID NO: 208 - DNA, 249 bp, Arabidopsis thaliana Mouse ear cress
  CDS (1)..(249)
atggagaacgacgcaggtcaggtcacagagctctacattccaagtaaatgctcggcaacaaacagaatgatcacatcaaaggatcatgcttcagttcagcttaacattggtcatcttgatgctaatggtctctacactggccaattcaccacttttgctctctgcggatttgtccgtgctcagggagacgcagacagtggcgtggacaggctctggcagaagaagaaggtcgaagctaaacaacagtga

SEQ ID NO: 209 - protein, 82 aa, Arabidopsis thaliana Mouse ear cress
MENDAGQVTELYIPSKCSATNRMITSKDHASVQLNIGHLDANGLYTGQFTTFALCGFVRAQGDADSGVDRLWQKKKVEAKQQ

SEQ ID NO: 210 - DNA, 249 bp, Oryza sativa japonica cultivar group
  CDS (1)..(249)
atgcagaacgaggagggtcagatggtggacctctacgtccccaggaagtgctcgaccaccaacaggatcatcaccgccaaggaccatgcctcggtccagatcaacattgggcatgtggatgagaatgggctgtacgatggccgcttcaccacgtttgctctctctgggttcatccgtgctcagggagacgccgacagtgctctggataggctgtggcagaagaggaaggctgaggtcaagcagcagtag

SEQ ID NO: 211 - protein, 82 aa, Oryza sativa japonica cultivar group
MQNEEGQMVDLYVPRKCSTTNRIITAKDHASVQINIGHVDENGLYDGRFTTFALSGFIRAQGDADSALDRLWQKRKAEVKQQ

SEQ ID NO: 212 - DNA, 252 bp, Ictalurus punctatus Channel catfish
  CDS (1)..(252)
atgcaaaacgacgctggagaattcgtggacctgtacgtgcctcgtaaatgctctgctagcaacagaattattggtgcaaaggaccatgcctccatccagatcaacattgctgaggttgacaaggtaacaggcaggttcaatggccagttcaagacctatgccatctgtggtgctattcgcagaatgggggaggctgatgactctctcctgagactggcaaagaacgactccattgtgtcaaagaacatataa

SEQ ID NO: 213 - protein, 83 aa, Ictalurus punctatus Channel catfish
MQNDAGEFVDLYVPRKCSASNRIIGAKDHASIQINIAEVDKVTGRFNGQFKTYAICGAIRRMGEADDSLLRLAKNDSIVSKNI

SEQ ID NO: 214 - DNA, 246 bp, Brachydanio rerio Zebrafish Danio rerio
  CDS (1)..(246)
atgcagaacgacgctggtgaattcgtggacctgtacgtccctcgtaaatgctctgctagcaacagaatcattggtgccaaggaccatgcctccatccagatcaacattgctgaggtggacagggttacaggcaggttcaatggacagttcaagacctatgccatctgtggcgccatccgtagaatgggtgaagctgatgactccctcctgaggctcgcaaagaccgacagcattgtggccaagtaa

SEQ ID NO: 215 - protein, 81 aa, Brachydanio rerio Zebrafish Danio rerio
MQNDAGEFVDLYVPRKCSASNRIIGAKDHASIQINIAEVDRVTGRFNGQFKTYAICGAIRRMGEADDSLLRLAKTDSIVAK

SEQ ID NO: 216 - DNA, 258 bp, Pectinaria gouldii
  CDS (1)..(258)
atgcagaacgaccagggagaaatcgtggatgtatacatccccaggaagtgctctgccacgaacaacattctggctgcaaaggaccatgcatcagtgcagatcaacatggctgagattgacccccaaactggcaggatgactggcaaacagatcacatatgctctgtgtggagagctcaggaggatgggtgaggctgatgacagtgtaaacagattggcaatgaaagacaaaatgctgtcagaggtcttcggtcattaa

SEQ ID NO: 217 - protein, 85 aa, Pectinaria gouldii
MQNDQGEIVDVYIPRKCSATNNILAAKDHASVQINMAEIDPQTGRMTGKQITYALCGELRRMGEADDSVNRLAMKDKMLSEVFGH

SEQ ID NO: 218 - DNA, 267 bp, Caenorhabditis elegans
  CDS (1)..(267)
atgcaaaacgacgccggacaaaccgtcgagctttacgttccacgcaagtgctcttcgtccaaccgcatcatcggaccaaaggaccacgcttccgtccaaatcgatttcgtcgatgtcgacccagagactggccgcatgatcccaggaaagtctacccgctacgccatctgtggagctatccgccgcatgggagaatccgacgacgctatcttgagacttgcccagaaggacggactcgtgccaagagatgatgttaagtccaactaa

SEQ ID NO: 219 - protein, 88 aa, Caenorhabditis elegans
MQNDAGQTVELYVPRKCSSSNRIIGPKDHASVQIDFVDVDPETGRMIPGKSTRYAICGAIRRMGESDDAILRLAQKDGLVPRDDVKSN

SEQ ID NO: 220 - DNA, 264 bp, Candida albicans Yeast
  CDS (1)..(264)
atggaaaacgataaaggtcaattagttgaattatacgtcccaagaaaatgttctgctaccaacagaatcattaaagccaaagatcacgcttctgttcaaatctcaattgctaaagttgatgaagacggtagagctattgctggtgaaaacatcacttacgctttaagtggttacgttagaggtagaggtgaagctgatgactcattaaacagattggctcaacaagacggtttattgaagaacgtctggtcttactctcgttaa

SEQ ID NO: 221 - protein, 87 aa, Candida albicans Yeast
MENDKGQLVELYVPRKCSATNRIIKAKDHASVQISIAKVDEDGRAIAGENITYALSGYVRGRGEADDSLNRLAQQDGLLKNVWSYSR

SEQ ID NO: 222 - DNA, 249 bp, Cyanophora paradoxa
  CDS (1)..(249)
atgcagaacgacgagggcaagattgtggacctgtacatcccgcggaagtgctccgcgaccaaccggctgatctcggccacggaccacgccgccgtccagatcaacgtcggccacgttgacccgaactctggcctgtacactggtgactacaccacgttcgccctgtgcggcttcgttcgcagcatgggcgagtcggacgccgcgctcaaccgcctgtgcgtgaagcacgggctggcgaaggccatttaa

SEQ ID NO: 223 - protein, 82 aa, Cyanophora paradoxa
MQNDEGKIVDLYIPRKCSATNRLISATDHAAVQINVGHVDPNSGLYTGDYTTFALCGFVRSMGESDAALNRLCVKHGLAKAI

SEQ ID NO: 224 - DNA, 252 bp, Mus musculus Mouse
  CDS (1)..(252)
atgcagaacgacgccggcgagtttgtggacctgtacgtgccgcggaaatgctccgcaagcaaccgcatcattgctgccaaggaccacgcgtccatccagatgaacgtggccgaggttgataggaccacaggccggtttaatggccagtttaaaacctatggcatctgcggggccattcgcaggatgggcgagtcagatgattctattctccgattggctaaggctgatggaattgtctcaaagaacttttaa

SEQ ID NO: 225 - protein, 83 aa, Mus musculus Mouse
MQNDAGEFVDLYVPRKCSASNRIIAAKDHASIQMNVAEVDRTTGRFNGQFKTYGICGAIRRMGESDDSILRLAKADGIVSKNF

SEQ ID NO: 226 - DNA, 264 bp, Neurospora crassa
  CDS (1)..(264)
atggagaacgatcgcggcgaaattgtcgacctttacgtcccccgcaagtgctctgcgacgggccgcatcatcaagtccaaggaccacggttcttgccagatcaccatcgccaaggtcgacgagaacggccgtgccatccagggcgagaacatcatctacgctctctccggcttcgttcgcgccatgggcgagtctgacgactccctcaaccgccttgcccagcgcgatggtctcctcaaggccgtctggaacccccagcgctaa

SEQ ID NO: 227 - protein, 87 aa, Neurospora crassa
MENDRGEIVDLYVPRKCSATGRIIKSKDHGSCQITIAKVDENGRAIQGENIIYALSGFVRAMGESDDSLNRLAQRDGLLKAVWNPQR

SEQ ID NO: 228 - protein, 33 aa, Artificial
  consensus
  misc_feature (2)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(28): Xaa can be any naturally occurring amino acid
  misc_feature (30)..(32): Xaa can be any naturally occurring amino acid
MXXXXXXXXXXYXPXKCSXXXXXXXXXXHXXXQ

SEQ ID NO: 229 - protein, 104 aa, Artificial
  consensus
  misc_feature (1)..(7): Xaa can be any naturally occurring amino acid
  misc_feature (9)..(9): Xaa can be any naturally occurring amino acid
  misc_feature (11)..(12): Xaa can be any naturally occurring amino acid
  misc_feature (14)..(15): Xaa can be any naturally occurring amino acid
  misc_feature (20)..(20): Xaa can be any naturally occurring amino acid
  misc_feature (27)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (39)..(39): Xaa can be any naturally occurring amino acid
  misc_feature (41)..(45): Xaa can be any naturally occurring amino acid
  misc_feature (48)..(64): Xaa can be any naturally occurring amino acid
  misc_feature (66)..(67): Xaa can be any naturally occurring amino acid
  misc_feature (69)..(70): Xaa can be any naturally occurring amino acid
  misc_feature (72)..(73): Xaa can be any naturally occurring amino acid
  misc_feature (75)..(76): Xaa can be any naturally occurring amino acid
  misc_feature (78)..(81): Xaa can be any naturally occurring amino acid
  misc_feature (84)..(104): Xaa can be any naturally occurring amino acid
XXXXXXXMXNXXGXXVDLYXPRKCSAXNRXIXAKDHASXQXXXXXVDXXXXXXXXXXXXXXXXXAXXGXXRXXGXXDXXXXRLXXXXXXXXXXXXXXXXXXXXX

SEQ ID NO: 230 - DNA, 1716 bp, Saccharomyces cerevisiae
  CDS (1)..(1716)
atgaatgatcctcgtgaaattttagcggttgatccgtacaataatattacttctgatgaagaggatgagcaagccatcgcgagagaacttgaatttatggaacgaaagaggcaggccttagtggaacgattaaaaagaaagcaagaatttaagaaaccccaggatcctaattttgaagccatcgaggtacctcaatctcctaccaaaaaccgtgtgaaagtggggtctcataatgctacacaacaaggcacaaaattcgaaggttcgaatattaatgaagtaaggttatctcaattacagcagcaaccaaaaccaccagctagtacaaccacatactttatggagaaatttcaaaacgcaaagaagaacgaagataaacaaattgccaagtttgaaagcatgatgaatgcaagagtacatacgttcagtaccgatgagaagaaatatgtgccgataatcacaaacgaattagaaagcttttcaaatctttgggttaaaaagaggtacatacctgaagatgacttaaaacgggctttgcatgagatcaaaatccttcggttgggcaaactttttgctaaaattcgcccacctaaatttcaagagcctgaatacgccaactgggccaccgtaggcctcattagccacaaatcggacatcaaatttacatcatctgaaaagccagtcaaattcttcatgttcaccataacggactttcagcatacactagatgtttatatcttcgggaaaaagggtgtagaaagatattataatcttcgcctgggtgatgtgatagcaatattaaacccagaagtactaccatggagaccctcagggcgaggaaattttatcaaatccttcaaccttcgaattagtcatgacttcaaatgtatcctggagataggttcaagtagagatttaggttggtgtcccatagtgaataaaaagactcacaaaaaatgtggctctcccattaacatatctcttcataagtgttgcgattaccatagagaagtgcaatttcgtggaacaagtgctaaaagaattgaattaaatggtgggtacgccttgggcgcgcctacgaaagtggactctcaaccaagcctatataaggccaaaggggaaaacgggtttaatataatcaaaggtactcgtaagcgcctgtcagaagaggaggaaagacttaaaaagagctctcacaattttacgaatagtaattctgccaaagcatttttcgacgagaaatttcagaatccagatatgctggcaaacttagacaataaaagaaggaaaataatagaaactaagaaatcgacagcactgagccgcgaactaggcaaaattatgagaaggagggaatccagcggattagaagataagagcgtcggagagcgacagaaaatgaaacgaaccacagaaagtgccctccagacagggcttatccaacgcctaggattcgatcccactcatggaaaaatttcccaagtactcaagtcttctgtatcagggagcgaacctaagaacaacttactcggtaaaaaaaaaactgttataaacgatctcttgcattacaagaaggaaaaagtcattctcgcaccttcaaagaacgaatggttcaagaaaagaagccatcgcgaagaagtttggcaaaaacatttcggatccaaggaaactaaagaaacttctgacggtagtgccagcgatcttgagataatataa

SEQ ID NO: 231 - protein, 571 aa, Saccharomyces cerevisiae
MNDPREILAVDPYNNITSDEEDEQAIARELEFMERKRQALVERLKRKQEFKKPQDPNFEAIEVPQSPTKNRVKVGSHNATQQGTKFEGSNINEVRLSQLQQQPKPPASTTTYFMEKFQNAKKNEDKQIAKFESMMNARVHTFSTDEKKYVPIITNELESFSNLWVKKRYIPEDDLKRALHEIKILRLGKLFAKIRPPKFQEPEYANWATVGLISHKSDIKFTSSEKPVKFFMFTITDFQHTLDVYIFGKKGVERYYNLRLGDVIAILNPEVLPWRPSGRGNFIKSFNLRISHDFKCILEIGSSRDLGWCPIVNKKTHKKCGSPINISLHKCCDYHREVQFRGTSAKRIELNGGYALGAPTKVDSQPSLYKAKGENGFNIIKGTRKRLSEEEERLKKSSHNFTNSNSAKAFFDEKFQNPDMLANLDNKRRKIIETKKSTALSRELGKIMRRRESSGLEDKSVGERQKMKRTTESALQTGLIQRLGFDPTHGKISQVLKSSVSGSEPKNNLLGKKKTVINDLLHYKKEKVILAPSKNEWFKKRSHREEVWQKHFGSKETKETSDGSASDLEII

SEQ ID NO: 232 - DNA, 25 bp, Primer
atgaatgatcctcgtgaaattttag

SEQ ID NO: 233 - DNA, 25 bp, Primer
ttatattatctcaagatcgctggca

SEQ ID NO: 234 - DNA, 2076 bp, Caenorhabditis elegans
  CDS (1)..(2076)
atggatcccctagatgacctactcacacagctcgagggagtcgaagaagaggagctaaagcctgtaaaccgagccccgcggcttctgaacatggaagaagcctgcgaaaatcaaggttctagtgagaaacccagcgattctagctcgaaaaatcgatatgaagatgatgatagtgatgatgaggagctttatgtgaaaaaacgagagctcacggagcaaggagctcttttaaagcggcatctggagaagaatagctcaacgagtgggccaaaggccacagatgcttggaaaactaataaaaaatcagtgctcaccgggctcacgaaaccatccaccgacacagtaaccgtcggaattgtgagattcgacaaatttcaaatatcgattcggaatccgaaaatttcggcgacaagttttggagcatttactgctggaatgaagcttgaaaagctatcaaatctgaaaccaacgtcaaatttcaaagaagcatggtgcacgattggtgttattgtggaaaagggtttcaagaagaaaagtgcaaatggaaatgattttttgatttggaaattacatgatttaaaggactgtcaaacccaaccagtgaagcttctaatgtttggagacgctattaaagatcactgggagattaagctgggctcagtaattgcattgatttctgctcaaattgccgatgattcgactgcttccggagctaaaaaaaccgtgtcggctacgctgaaagtggcaaaatcgaataatatcgtggaaattggacaatccgcacattttgggacttgtaagggaatccgacaacaagacggccaacgatgcagtaattttgtaaattcttcgctcagcgaattctgtgtattccacgtgatgagcgctgcgaggaaattgtcggctaagagaggtgtgttcaacgcggtgacatgtggcccaaacgtgggcggcctctcattcaacaagaagcccggcacgccccgcccaccgatttccagccgaccaggaatttccggctccggacttgccacctccagcggctccccaatgctccgtgacacaatgcgaccagcagacagcttcacgctgaccacaccgacttctggcctgaaaaagattacaaaagaggaggagaaatcgtcgttaaatgatcttttgagccaaagaaaaaacacgtttgccgcccgtcaaatgctgaaactcaaagagaaaaaagatgagaaactggctgaaagtgtggaggaaatgattgaatttttgggaactacaggcggcgaagaaaagccatcagttcattcgagttttggcgaatttctagcagccgacacccgacgggaaaaggcggctactgtcgatttacgagcttcttctgcaacttctggaacaagtgcttcttctccaggcggttcaaagctatggacaatgtcactggcgaataagaaagctgctccgttaggtcataaagatgctcaggagcatgccgctaggctccgcgcaatcgcaattctcaaggcaaaacgaaaagaagccgaaatggagaagctcaccggaggcggcggcggagtcaagcgaaaagcttccggaacaccgacggctccggagcccgaagcaaagaagccgagaagccagaaaatggatgagattcgtgcgatgctcgccagaaagagcacacatcacaaggaagcggagaaggcggagcacgacatgctccagcgtcatttgacaggaatggaagaacgcgaaaaagtggaaacatttacgacgacttgtgttgaagttaaaaatgttaaagttgtcacgtgtaatcagtgcaaatacacatcacaattcgcatcatcagaatgtattaaaaaagagcataaactcattaaacacaccgctgacaagcgattcttcaaatgtactggatgcaaaaaacggactgtttgttttgaaatgatgcctgtcaagcattgtgcgcactgcaacgagaacaaatgggagcgcgtagcgatgaaagacgaacgaaaagtggttctcgacacggaaaatctgctgctccgcggtgaagaacgtccgtttgttggctcctaa

SEQ ID NO: 235 - protein, 691 aa, Caenorhabditis elegans
MDPLDDLLTQLEGVEEEELKPVNRAPRLLNMEEACENQGSSEKPSDSSSKNRYEDDDSDDEELYVKKRELTEQGALLKRHLEKNSSTSGPKATDAWKTNKKSVLTGLTKPSTDTVTVGIVRFDKFQISIRNPKISATSFGAFTAGMKLEKLSNLKPTSNFKEAWCTIGVIVEKGFKKKSANGNDFLIWKLHDLKDCQTQPVKLLMFGDAIKDHWEIKLGSVIALISAQIADDSTASGAKKTVSATLKVAKSNNIVEIGQSAHFGTCKGIRQQDGQRCSNFVNSSLSEFCVFHVMSAARKLSAKRGVFNAVTCGPNVGGLSFNKKPGTPRPPISSRPGISGSGLATSSGSPMLRDTMRPADSFTLTTPTSGLKKITKEEEKSSLNDLLSQRKNTFAARQMLKLKEKKDEKLAESVEEMIEFLGTTGGEEKPSVHSSFGEFLAADTRREKAATVDLRASSATSGTSASSPGGSKLWTMSLANKKAAPLGHKDAQEHAARLRAIAILKAKRKEAEMEKLTGGGGGVKRKASGTPTAPEPEAKKPRSQKMDEIRAMLARKSTHHKEAEKAEHDMLQRHLTGMEEREKVETFTTTCVEVKNVKVVTCNQCKYTSQFASSECIKKEHKLIKHTADKRFFKCTGCKKRTVCFEMMPVKHCAHCNENKWERVAMKDERKVVLDTENLLLRGEERPFVGS

SEQ ID NO: 236 - DNA, 1782 bp, Schizosaccharomyces pombe
  CDS (1)..(1782)
atgcatgatcccttcattgcagaagaaaatgacttggacctggaagaaaagaggttacagaggcagctaaatgaaattcaagaaaagaagcgtctacgaagtgctcaaaaggaggcttcttcggagaacgctgaagttattcaggttccaagatctcctcctcagcaagttcgtgtccttacagtcagctcgcctagtaaactaaaaagtcccaagcgattgatattaggaatcgataaaggaaagacggggaaagatgtttcattaggaaaagggcctcgagggcctctaccaaaaccatttcacgaacgacttgcagaggcaaggaaccaagaaaggaagaggagcgataaattgaaaacgatgaaaaaaaatagaaagcaatcgttccagaggaagcgaaacatacttgaagatggaaaaagtgaagaggagaaatttcctatgaaatgtgatgaaatcgatccttattcaagacaagccattgttattcgatacataagtgatgaggttgctaaggaaaatatagggggaaatcaagtttatctcattcaccaactactcaaactagtaagagctcctaaatttgaagcgccagaagttgacaactatgtagttatgggcattgttgccagtaatagtggaaccagagaaactgtgaatgggaataaatattgtatgctaacactgactgacttgaaatggcaactggagtgcttcctgtttggaaaggcgtttgaacgatactggaagatccagagtggtactgtcattgcgcttctcaatcctgaagtactaaagccaaagaacccagacattggacgcttttctctgaagctggattctgagtacgatgtacttttagagattggtcgctccaaacaccttggctattgttccagccgaagaaaaagcggtgaactatgtaaacattggctcgacaagcgtgccggagatgtatgtgaatatcacgttgacctcgctgtccagcggtccatgtctacgcgaacggagtttgcttcaagtatggcgactatgcacgagcctcgcgcacgacgtgaaaagcgatttcgtggacaagggttccaaggatactttgctggggaaaagtattccgcaattcctaacgcagtagctggtttgtatgatgcagaagacgccgttcagaccgagagggagcgcaaggaacgatacaaaaaacaacgagcgcaggctgaacgcgagcgtgaaattttggtgcgattatcgaagcgatgttgcgcttcctcttcgtctagctctaactcgaataacctctctacgggaatgtcgatgcgaacactcggccatcagtatctaaatttacaaggttccggcgttaaaaatttacatgacaagggtaatcccactgctctttctaaagatagcgaaattgattcatcgacgaaaaaaccatccgttctggcctcttttaatgcatctataatgaaccctaaatcctctctaccatctttttctaactctgctattctcggcactaacgatgcggcatcagggacacccgttccacaagatactacatccaccaaagtttccccagcggtagtgtttacctcttcgccgaggattttttccccccaaagtctacgaaaaataggtttcgatccaacgcattccgcagatgcatctacaacgcactccacagcgactggactttcacgatccggctccctaaaaaatatcaaattccgatatgaatttactgagagtgatgatgaggatgacttagaaatagttccctaa

SEQ ID NO: 237 - protein, 593 aa, Schizosaccharomyces pombe
MHDPFIAEENDLDLEEKRLQRQLNEIQEKKRLRSAQKEASSENAEVIQVPRSPPQQVRVLTVSSPSKLKSPKRLILGIDKGKTGKDVSLGKGPRGPLPKPFHERLAEARNQERKRSDKLKTMKKNRKQSFQRKRNILEDGKSEEEKFPMKCDEIDPYSRQAIVIRYISDEVAKENIGGNQVYLIHQLLKLVRAPKFEAPEVDNYVVMGIVASNSGTRETVNGNKYCMLTLTDLKWQLECFLFGKAFERYWKIQSGTVIALLNPEVLKPKNPDIGRFSLKLDSEYDVLLEIGRSKHLGYCSSRRKSGELCKHWLDKRAGDVCEYHVDLAVQRSMSTRTEFASSMATMHEPRARREKRFRGQGFQGYFAGEKYSAIPNAVAGLYDAEDAVQTERERKERYKKQRAQAEREREILVRLSKRCCASSSSSSNSNNLSTGMSMRTLGHQYLNLQGSGVKNLHDKGNPTALSKDSEIDSSTKKPSVLASFNASIMNPKSSLPSFSNSAILGTNDAASGTPVPQDTTSTKVSPAVVFTSSPRIFSPQSLRKIGFDPTHSADASTTHSTATGLSRSGSLKNIKFRYEFTESDDEDDLEIVP

SEQ ID NO: 238 - DNA, 2817 bp, Neurospora crassa
  CDS (1)..(2817)
atgtcccgttcgaaccccgccctagcggcgcgctacaccgacaatgaggacgccgttatgattgacgtggacgacgtggaggatgacgacgacgaagacgaggagatggtacagctgaagctgcaggaaatccaggcgcgcatgaagttgaaaaagatacaaaatgcaaaggcgcaaagaagggctaactcgtccatggatgcacgatcgaatggaggccgaccagaaagcgcttcggccaacaacaacaataacaacaactcgatgcagcccccggccggacttcccattcagtcaaggttagctgcggcaagagataggatggaacaacagtcaaattccgttcagatccccgcttcgccggtcaggaggggacgtagtgaatccgctcctcagccacctcagtcccccacgaggctcatgttgggaatcgacaagggacgaaaagcggccgacatgtcactgaaaagggcgcccacattacgaaaggtcgaaagcgaacgtccctcccagaatctaaactcccaacagtcaggctacttgcgacggtccatgacgacatcctttagcgaagatcaacccagctctagctcccgtcgtcctgtcagcttcgacgggcgcgcaagttctttctcgcaggcagaagaaaggcgtcctttaagtttcaacgagcgtctagcatgcgccaggaacgaagagcaggagcgcagggaaaaggcacagaggatacagaagatcaggagtaatgccttcagtatcggcagggaagagatggaggagtacaagacaaaagcggtggatgttcccgaagttccatacaaagccccagaatattctcgcgacgatatcctgtcagcgactggaagatcttcatcaaggccaacaaccatgagcgcatcatcatcgttcacacaaccaagctcaacacaagtcaactcggacaatgaacctggcttcgaaccttattcaggtcttcgcctgtccaagcgcattcttccccataatgtggtcactcgcgctattacaggcaagaagacctacggtttgaaggaccttttgcggcaagtcaaggcaccggactggtcccttcccgatgtcgagtctgatgtagtcgttttcgccattgtcgcaaccaagtctgaaccgcgcagccatcgtagcgatggcaagcccttgcaagaacgtggcaagtacatggtcatcagcctctgtgatcttcagtatgaagtggaactgtttctctttaactccggattcgaccgcttctggaagctcacgccgggaaccattctcgccatcctcaaccccaccatcatggcgccaaaacaaggtcagcaagatactggtcggttctcattggtgatcaacagcgatgaggataccattttggagattggtaatgcgcgcgacctaggttattgcaagagcatcaagaaggatggcatgctttgcaagagttgggtcaacctccgtcgtacagagtattgcgagttccataccaacgaagcagtcaccaagtcgagacagggaaggttggaattgaacaactcattcgggtttggagacaaatataagcaaaactctaggtacgccaagagtgaagaggccaagagaaaagaggaggaaatacgactgaggggtcaatacgaccggtcaaccggcagtcacttcttcatgaaccgtactgccgcggagctcattgatggcggtggcatggctgatcaggctgagaagaaggaggctatcaagagaagcttggcgaggaaggagaaggaagctgagattgcaagaaaactgggcgaggtgggtggtggtgctgggagagattacatgagtcgagccgctggtggtcttcgcgcaagtttctcttctaccaattcagtacccatgtcaggctctacctccttctcgtcagccacagcctcgacacccatgtcgtcactgtctggccacagccaaagcaacagcacaaatgacccgctaggctttggcggcagaccccgatatgaccttcaagccctcggtctactccgcaaaaagggcgaagaacaacccaaaatcgatctcggcccaataaagcgcaagcgtcccgagtccgcccagtcaagtgaaaacagcttcagcaagtccaactctaccagcagcgcaaccatcaccccctccaactacaccaccaacacgaaagccccctccttgggctggggctccagcctgcgcgacaagctttcgagaatgaaagaaggcgagcggctcaacctttcccaccgccccagcaactccagcatgcgcgattccacccccgcccttaccaactcctcgtccaccaccgcttcgaccggcctcaccccggccatcaaccgtctctccacctccgctagagacttcaactttacaaactcctcctccaacacccagactaacctccctaaccgcccctcacccgccgtccgcttctccgccgcccccaataattcttctggtactacaaccaccaccaacggtcccaccacttcccatcaccaccaccactcctcctccttatcctcctctcgcctcctcggcgtctccgcctccgcacgtctagcagctgcgagagcagccgccgccgcacaagctgctgctgctgctgatgggcactcgcaagggtcgcaaccgcctgtcagaaaaaagacgcggttcgtgacggataaggggatcagagaggcgggcagggatagtctgggggacaaggggtttttgatgagtgcggcgcagaagaataggaggcaggtggtgctgagcgaggatgatgatgatgacttgattgttttgaaataa

SEQ ID NO: 239 - protein, 938 aa, Neurospora crassa
MSRSNPALAARYTDNEDAVMIDVDDVEDDDDEDEEMVQLKLQEIQARMKLKKIQNAKAQRRANSSMDARSNGGRPESASANNNNNNNSMQPPAGLPIQSRLAAARDRMEQQSNSVQIPASPVRRGRSESAPQPPQSPTRLMLGIDKGRKAADMSLKRAPTLRKVESERPSQNLNSQQSGYLRRSMTTSFSEDQPSSSSRRPVSFDGRASSFSQAEERRPLSFNERLACARNEEQERREKAQRIQKIRSNAFSIGREEMEEYKTKAVDVPEVPYKAPEYSRDDILSATGRSSSRPTTMSASSSFTQPSSTQVNSDNEPGFEPYSGLRLSKRILPHNVVTRAITGKKTYGLKDLLRQVKAPDWSLPDVESDVVVFAIVATKSEPRSHRSDGKPLQERGKYMVISLCDLQYEVELFLFNSGFDRFWKLTPGTILAILNPTIMAPKQGQQDTGRFSLVINSDEDTILEIGNARDLGYCKSIKKDGMLCKSWVNLRRTEYCEFHTNEAVTKSRQGRLELNNSFGFGDKYKQNSRYAKSEEAKRKEEEIRLRGQYDRSTGSHFFMNRTAAELIDGGGMADQAEKKEAIKRSLARKEKEAEIARKLGEVGGGAGRDYMSRAAGGLRASFSSTNSVPMSGSTSFSSATASTPMSSLSGHSQSNSTNDPLGFGGRPRYDLQALGLLRKKGEEQPKIDLGPIKRKRPESAQSSENSFSKSNSTSSATITPSNYTTNTKAPSLGWGSSLRDKLSRMKEGERLNLSHRPSNSSMRDSTPALTNSSSTTASTGLTPAINRLSTSARDFNFTNSSSNTQTNLPNRPSPAVRFSAAPNNSSGTTTTTNGPTTSHHHHHSSSLSSSRLLGVSASARLAAARAAAAAQAAAAADGHSQGSQPPVRKKTRFVTDKGIREAGRDSLGDKGFLMSAAQKNRRQVVLSEDDDDDLIVLK

SEQ ID NO: 240 - DNA, 2568 bp, Homo sapiens Human
  CDS (1)..(2568)
atggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaagccttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagtgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagcctcagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttaa

SEQ ID NO: 241 - protein, 855 aa, Homo sapiens Human
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKPSPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKASASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKVCHLRTNF

SEQ ID NO: 242 - DNA, 2625 bp, Homo sapiens Human
  CDS (1)..(2625)
atggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataa

SEQ ID NO: 243 - protein, 874 aa, Homo sapiens Human
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 244 - DNA, 2658 bp, Mus musculus Mouse
  CDS (1)..(2658)
atggatgtggaggaagacgacttgtgtctcctgacatctctactggaagagaatgaggcagtcttaccttgcagctcagaaaaggataagtccttgtctctgggagacggggaccctgatgaatttgatgagctctttgatgctgatggtgatggtgagtcttacacagaagaggctggcagtggagaagagggcaagactggaaaccaggaggaacgtttggccactctctttggtgatgtggaggacttaacggatgatgaagttgctacatcgaaagttggaaacagtggcccccctcctgctcccagccaagagaaaaccagcgaggagctgcaagatgaattaaagaagttgcaagagcaaatgaaatccttacaggagcagctaaaagctgcatcaattaaacagcctccagggacagcacccttgcaggaaccacctgattcatctctgcagccactgcttaaggagaagagaattcggagaattcaggagtcagcgtgcttttctgcagagcttgatgtccccactttacccaaagccaagcgggttgctcggaagccaaagactcctgcagagtcatcttcaaggatgcgtacacccgcacagccactacaggtttcttccagttttctagagcctaaccactcctcttcttcgagatcaagcacaccctcacctcaagctgttcctggaaacaaatgtagcaggacaattagaaatcaaaacacagtgtccccagggaattctggggaccggccccagcaggtttcccaggtctctgtggaagccttctcaggcctacgcctcaggcgacctcgagtctcctccacagaaatgagcaggaagatggcaggccggaaactaatcagactgcctcagatcaaggagaagatggcaactgagaacctggaagagacagactgggtgacgtttggggttatcctcaggaaggtcactccacagagtgctaccagtgggcaaacgtttagcatctggaaactgaacgaccttcatgacctgactcagtgtgtgtccttgttcttgtttggagatgttcacaaagatctctggaagacagagcaagggaccgtcataggcttgctcaacgcaaaccccatgaagcccaaagatggcttgaaagaggtgtgcttatctattgatcatcctcaaaaagtcttaattatgggagaagctatggacctgggagcctgtaaagccaagaagaagaatggagagccatgtacacagacagttaacttgcatgactgtgaatactgccagtatcacatccaggcccagtacaagaagctcagcgcaaagaggactgatctgcagtccactttctctgggggacggattccgaagaagttccgcaaaggcaccagcctgaaggagcggctgtgccaagatggtttctactatggtggtgtttcttccgaatccttcgcagcgtccagggcggcggccattgctcctaagaagaaggttcaaaccacgctgaccaatctggttgtccggggcacaaactcgatcatccaggaaacaaaacaaaagcttggtattccccagaagagcttgtcctgctctgaggagttcagggaattgatggccctgcccacatttggagccagaaacttacaaaagcatctagccagagccaaggcttcagggagttccaaacctgccatccagtccatctcagcatcagccctcttgaagcagcagaaacaacagatgctggagatgcggaagaggagatcagaagacatacagaagcgattcctccaaagctcaagtgaagtccagagcccagcagtgccgtcttcctctcgacaggctgctgcccagtctcctcgaactggggctgagttccccaggttggaaggaactgcaaccccacggatgcccaagctgggcagaggcatctcagaaggggacgatgttctcttctttgatgattcaccaccaccaagaccaaaactgagcgcagcagcagaagctaaaaagttagttgctattgcaaaattaagggcaaaaggccagattctcacaaaagtagatccaaacaatactgtaaggaagcaaatggatggccgagccatgctgggagtgaaggagcgtgtggagaatagcaacacagtttctcctgaagaggagctggagcctgccaggaaaaaaaggagagagcagcttgcctacttagagtccgaggaatttcagaagattctaaaagcaaagtccaagcacacagacatcctgaaagaggctgaggctgagctacagaaatcctattttgagccactggtgaaaaaagaacagatggaagaaaagatgagagccacccgggaagtgaaatgccgcgtggtgacgtgcaggacgtgcacctatacccacttcaagcctctggagacctgtgtcagcgagcagcataacctccactggcacgacggcgtgaagaggtttttcaaatgtccctgtggaaacaggaccatctccctggacaagctcccaaacaagcactgccgtaactgtggcctctacaagtgggaacgggatggaatgctgaaggagaagacaggtccaaagataggaggagagaccctgctgccgagaggggaagagcacgccaagtttctgaacagcctcaagtaa

SEQ ID NO: 245 - protein, 885 aa, Mus musculus Mouse
MDVEEDDLCLLTSLLEENEAVLPCSSEKDKSLSLGDGDPDEFDELFDADGDGESYTEEAGSGEEGKTGNQEERLATLFGDVEDLTDDEVATSKVGNSGPPPAPSQEKTSEELQDELKKLQEQMKSLQEQLKAASIKQPPGTAPLQEPPDSSLQPLLKEKRIRRIQESACFSAELDVPTLPKAKRVARKPKTPAESSSRMRTPAQPLQVSSSFLEPNHSSSSRSSTPSPQAVPGNKCSRTIRNQNTVSPGNSGDRPQQVSQVSVEAFSGLRLRRPRVSSTEMSRKMAGRKLIRLPQIKEKMATENLEETDWVTFGVILRKVTPQSATSGQTFSIWKLNDLHDLTQCVSLFLFGDVHKDLWKTEQGTVIGLLNANPMKPKDGLKEVCLSIDHPQKVLIMGEAMDLGACKAKKKNGEPCTQTVNLHDCEYCQYHIQAQYKKLSAKRTDLQSTFSGGRIPKKFRKGTSLKERLCQDGFYYGGVSSESFAASRAAAIAPKKKVQTTLTNLVVRGTNSIIQETKQKLGIPQKSLSCSEEFRELMALPTFGARNLQKHLARAKASGSSKPAIQSISASALLKQQKQQMLEMRKRRSEDIQKRFLQSSSEVQSPAVPSSSRQAAAQSPRTGAEFPRLEGTATPRMPKLGRGISEGDDVLFFDDSPPPRPKLSAAAEAKKLVAIAKLRAKGQILTKVDPNNTVRKQMDGRAMLGVKERVENSNTVSPEEELEPARKKRREQLAYLESEEFQKILKAKSKHTDILKEAEAELQKSYFEPLVKKEQMEEKMRATREVKCRVVTCRTCTYTHFKPLETCVSEQHNLHWHDGVKRFFKCPCGNRTISLDKLPNKHCRNCGLYKWERDGMLKEKTGPKIGGETLLPRGEEHAKFLNSLK

SEQ ID NO: 246 - DNA, 2583 bp, Xenopus laevis African clawed frog
  CDS (1)..(2583)
atggaagttgacgctgacctcgagctgctaacctctttgttagaagaaaatgaggctgctgagaggaatggtgttgtgagccatgaagcctcaagtgagcttgatgaatttgacgaactctttgatggcgatgaagatggatcttatcatggaagtgataatgggactgaggagcaaaccataggtggagtagaagaagactttaccacactatttggtgacattgatgatattaaagaagaggaagcagctgcatctgataccaagaagcaatcttcttcagtttgccaggaaaaatcaaaagatgaattagaagatgaactaagaaagatgcaggcgcagatgaagaaattgcaggaacagttgcaaaaaacagcacttgcaaaaacatcaagccctggtaatcctaagaaatcaccagaaaataaaatggtacagtcaggtaaaacatctcggacaagccctttgatagaaagaaagaaaacagattccaacactgttgctcctcaacttacaagtccaactgtcccgaaggcgaaattaccagatgctcccaaaagaaaacaaaatctttcagataagagcccagttcaaaagaaaatggctagtttcttatctccacctgaaaaatcctctgccagacctggccaatcaacagcgacacagcctataacaaacacattaaaatcccctgtaggtcagcaatatcatgtagagaaattttctggactaagaataaggaaaccacgagtgtcctcttcagaaatggaacggaaaatgaatgggcggaaattgatcagattggctcagctgcagaacaaaattgcaactgagaaactggaggaggaagattgggttacatttggtgtaattgtaaagaaaattaccccacaaagttcaaacaatggtaagacattcagcatttggaggctgaatgatttgaaggatttggataaatacatatccctgttcttgtttggagatgtccataaagagcactggaaaacagaccagggaactgttattggtctccttaatgctaacccaatgaaaccaaaagaaggcactgatgaggtgtgtttatctgttgacaatcctcagaaggtcttgctcatgggagatgcagtggatttgggaacctgtaaggcccggaaaaaaaatggagatccatgtacacaaatggtcaacctgaatgactgcgagtattgccagtatcacgtccaagcacagtataagaaagtgagttctaagcgagcggaccttcagtcaagctactctggtcatgttcctaaaaagatggcacgtggtgcaaatggtctgagagagcgcctgtgtcaaggtggttttcattatggaggtgtttcttctatggcatatgctgcaacactaggatccactactgctcccaagaaaactgtccagtcaactctttctaacatggttgtccgtggagcagaagcaatagcacttgaagcaaggcagaagattgctgcagcaaaaaatgtggtacaaactgatgaattcaaagagctgatgactttgccaacaccaggagcgctgaacttgaagaagcatttgtctggtgtgtctcctcaagcaaattgtggaaaagaaggccagcctattcaatccatatctgcatcaactcttttaaagcagcagaagcagcagatgctgaatgcaagaaagaaaagagcagaggagagtcaaaagaggtttcttgaaagcactgagaaatccgagaaatcaagtactttgacatcttctgcgtgctcggtgtttcagtccccaaaacaaggtgcagaatttccaaatgcacagaagatggcaacacccaaattaggccgtggctttgctgaaggagatgatgttctcttttttgatatttctcctcctccggctcccaaattaagtacttctgctgaagcgaaaaagctattggctattcagaagctacaagccaaaggacaaacccttgccaaaacagatccaaacagcattaaacgcaagcgaggtagttcatcagaagagctggttgctcagagagtggcgtcacatgcatcaacatcccccaaatctcctgatgagaatgagcccgccattaaaaagcacagagatcagttggcctatctagagtcagaagagtttcagaagattttgaatgccaaatccaaacacactggtatcctcaaggaggctgaagtagagatccaagaacattattttgatccccttgttaaaaaagagcaactagaagagaaaatgcaaagcatcagggagcaatcgtgtcgtgtagttacatgtaaaacgtgcaagtacactcacttcaaacctaaagagacctgtgttagtgaaaaccacgatttccattggcacaatggtgtgaaaaggttctttaaatgtccctgtggtaacagaactatatccttggatagactgcccaagaagcattgcagcacttgtggcctctttaagtgggaaagagttggtatgcttaaggaaaaaactggcccaaaattaggaggagaaacacttttgccaagaggagaggaacatggcaaatttctgaatagccttaaataa

SEQ ID NO: 247 - protein, 860 aa, Xenopus laevis African clawed frog
MEVDADLELLTSLLEENEAAERNGVVSHEASSELDEFDELFDGDEDGSYHGSDNGTEEQTIGGVEEDFTTLFGDIDDIKEEEAAASDTKKQSSSVCQEKSKDELEDELRKMQAQMKKLQEQLQKTALAKTSSPGNPKKSPENKMVQSGKTSRTSPLIERKKTDSNTVAPQLTSPTVPKAKLPDAPKRKQNLSDKSPVQKKMASFLSPPEKSSARPGQSTATQPITNTLKSPVGQQYHVEKFSGLRIRKPRVSSSEMERKMNGRKLIRLAQLQNKIATEKLEEEDWVTFGVIVKKITPQSSNNGKTFSIWRLNDLKDLDKYISLFLFGDVHKEHWKTDQGTVIGLLNANPMKPKEGTDEVCLSVDNPQKVLLMGDAVDLGTCKARKKNGDPCTQMVNLNDCEYCQYHVQAQYKKVSSKRADLQSSYSGHVPKKMARGANGLRERLCQGGFHYGGVSSMAYAATLGSTTAPKKTVQSTLSNMVVRGAEAIALEARQKIAAAKNVVQTDEFKELMTLPTPGALNLKKHLSGVSPQANCGKEGQPIQSISASTLLKQQKQQMLNARKKRAEESQKRFLESTEKSEKSSTLTSSACSVFQSPKQGAEFPNAQKMATPKLGRGFAEGDDVLFFDISPPPAPKLSTSAEAKKLLAIQKLQAKGQTLAKTDPNSIKRKRGSSSEELVAQRVASHASTSPKSPDENEPAIKKHRDQLAYLESEEFQKILNAKSKHTGILKEAEVEIQEHYFDPLVKKEQLEEKMQSIREQSCRVVTCKTCKYTHFKPKETCVSENHDFHWHNGVKRFFKCPCGNRTISLDRLPKKHCSTCGLFKWERVGMLKEKTGPKLGGETLLPRGEEHGKFLNSLK

SEQ ID NO: 248 - protein, 61 aa, Consensus
  misc_feature (2)..(13): Xaa can be any naturally occurring amino acid
  misc_feature (14)..(14): Xaa can be any naturally occurring amino acid or can be omitted
  misc_feature (16)..(20): Xaa can be any naturally occurring amino acid
  misc_feature (22)..(22): Xaa can be any naturally occurring amino acid
  misc_feature (24)..(33): Xaa can be any naturally occurring amino acid
  misc_feature (35)..(45): Xaa can be any naturally occurring amino acid
  misc_feature (47)..(48): Xaa can be any naturally occurring amino acid
  misc_feature (50)..(60): Xaa can be any naturally occurring amino acid
LXXXXXXXXXXXXXGXXXXXGXCXXXXXXXXXXCXXXXXXXXXXXCXXHXXXXXXXXXXXR

SEQ ID NO: 249 - protein, 1007 aa, Consensus
  misc_feature (1)..(42): Xaa can be any naturally occurring amino acid
  misc_feature (44)..(162): Xaa can be any naturally occurring amino acid
  misc_feature (164)..(187): Xaa can be any naturally occurring amino acid
  misc_feature (189)..(357): Xaa can be any naturally occurring amino acid
  misc_feature (359)..(377): Xaa can be any naturally occurring amino acid
  misc_feature (379)..(379): Xaa can be any naturally occurring amino acid
  misc_feature (381)..(383): Xaa can be any naturally occurring amino acid
  misc_feature (385)..(405): Xaa can be any naturally occurring amino acid
  misc_feature (407)..(437): Xaa can be any naturally occurring amino acid
  misc_feature (439)..(439): Xaa can be any naturally occurring amino acid
  misc_feature (441)..(448): Xaa can be any naturally occurring amino acid
  misc_feature (451)..(458): Xaa can be any naturally occurring amino acid
  misc_feature (460)..(463): Xaa can be any naturally occurring amino acid
  misc_feature (465)..(465): Xaa can be any naturally occurring amino acid
  misc_feature (467)..(469): Xaa can be any naturally occurring amino acid
  misc_feature (472)..(490): Xaa can be any naturally occurring amino acid
  misc_feature (492)..(500): Xaa can be any naturally occurring amino acid
  misc_feature (502)..(503): Xaa can be any naturally occurring amino acid
  misc_feature (505)..(508): Xaa can be any naturally occurring amino acid
  misc_feature (511)..(511): Xaa can be any naturally occurring amino acid
  misc_feature (513)..(517): Xaa can be any naturally occurring amino acid
  misc_feature (519)..(519): Xaa can be any naturally occurring amino acid
  misc_feature (521)..(522): Xaa can be any naturally occurring amino acid
  misc_feature (524)..(527): Xaa can be any naturally occurring amino acid
  misc_feature (529)..(534): Xaa can be any naturally occurring amino acid
  misc_feature (536)..(537): Xaa can be any naturally occurring amino acid
  misc_feature (539)..(549): Xaa can be any naturally occurring amino acid
  misc_feature (551)..(612): Xaa can be any naturally occurring amino acid
  misc_feature (614)..(1007): Xaa can be any naturally occurring amino acid
XXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXGXKXXXLXXXXXXXXXXXXXXXXXXXXXVXXXXXXXXXXXXXXXXXXXXXXXXXXXXXXXLXDXXXXXXXXLFXXXXXXXXWXXXXGXVXXXLNXXXXXXXXXXXXXXXXXXXLXXXXXXXXXLXXGXXXXLGXCXXXXXKXGXXCXXXXNXXXXXXCXXHXXXXXXXXXXXRXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 250 - DNA, 519 bp, Saccharomyces cerevisiae
  CDS (1)..(519)
atggagcacgtatcaaagaggtcaattgggcaattctttaagaggaaaacttcaactgtagatggaagcaaatcacagaaatgcggaaccactaaccaactgcggaagctgctgcataaaagaagggtacagaagcaggcagtgccggttgaatcccagtacagaattccgggtgattttagggataatcaaagcgtgagagtcaaaaactctatgtacaacagctcaccgtcagtaacgccatctacgcatcatatcaatgaaaggtatgttcgctatgacatcaacacaaggcctttggttgttgtgctcgcgatctcaattgtattttttggctgtctcctggtcctcaaggacatcatcatccagtcatcagaaaacatcctgagtgtttccaaatggaaaatcataggggcctccttcatgggtacgccctacacaggtcttctcacggggctcgttggccctctcctgtcaccattttcggctgtttcgtcgtggctttcattcatcttttga

SEQ ID NO: 251 - protein, 172 aa, Saccharomyces cerevisiae
MEHVSKRSIGQFFKRKTSTVDGSKSQKCGTTNQLRKLLHKRRVQKQAVPVESQYRIPGDFRDNQSVRVKNSMYNSSPSVTPSTHHINERYVRYDINTRPLVVVLAISIVFFGCLLVLKDIIIQSSENILSVSKWKIIGASFMGTPYTGLLTGLVGPLLSPFSAVSSWLSFIF

SEQ ID NO: 252 - DNA, 24 bp, Primer
atggagcacgtatcaaagaggtca

SEQ ID NO: 253 - DNA, 25 bp, Primer
tcaaaagatgaatgaaagccacgac

SEQ ID NO: 254 - DNA, 486 bp, Saccharomyces cerevisiae
  CDS (1)..(486)
atgataaaagtcgatacttccgatgcattgttgaaaaattcgttaacatcaataaaatggacattaaatatgttggatattttattcagttgtgacattttttcattaatcaaggattccatacgttctttgataacagaaacattttcctcggtgaataccgtgagtacatcgacggtaaagcctgtacgattattgtgttgcttagtttgttccaatagcaagtcgtgcacaatatctaacataaccagagatcctgaatcagaatgtgataaggggagcagaatcttagagacggatccttctttttcaaatgggtatataactttaaataggttcctgaaatattcatccttcatcatttgtttcctttgtttagtactaacaaacttgatgaaacattcatcgcaaaacttttcctttctagactcaactgtcgctggatttctggcagatgcagggcacctctggcactccataacttga

SEQ ID NO: 255 - protein, 161 aa, Saccharomyces cerevisiae
MIKVDTSDALLKNSLTSIKWTLNMLDILFSCDIFSLIKDSIRSLITETFSSVNTVSTSTVKPVRLLCCLVCSNSKSCTISNITRDPESECDKGSRILETDPSFSNGYITLNRFLKYSSFIICFLCLVLTNLMKHSSQNFSFLDSTVAGFLADAGHLWHSIT

SEQ ID NO: 256 - DNA, 25 bp, Primer
atgataaaagtcgatacttccgatg

SEQ ID NO: 257 - DNA, 23 bp, Primer
tcaagttatggagtgccagaggt

SEQ ID NO: 258 - DNA, 2142 bp, Escherichia coli
  CDS (1)..(2142)
atgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataa

SEQ ID NO: 259 - protein, 713 aa, Escherichia coli
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTDEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 260 - DNA, 23 bp, Primer
atgaacatcattgccattatggg

SEQ ID NO: 261 - DNA, 24 bp, Primer
ttatcccgccatttttaggactcg

SEQ ID NO: 262 - DNA, 1458 bp, Zea mays.
  CDS (1)..(1458)
atgcctctggtctgtgcactgcaattaactgccagacaagatgtttcctgctttcacttcccaggacacaacagaggaaaagctgctccatcttccttgtcgaaactcattggctcaggggcatttctgcatgacttgcccgagctacccgagctcgatgatctcttctccccaaaaggtgtgattctagatgcccagaggcgagcagctcaactgtttgggtcatctaaaacttggttccttgtcaacggaacgacctgtggaatccaggcctcagtgatggctacctgttctcctggcgactacctcattgtgccacggaactgccacctttcagtgatctctgcgctggtcttgtctggtgtggtgcctaaatacataataccagaatataattctgggtgggacattgctggtggtatcaccccgctgcagctggatgaagcagtaaaagagctggaggaggatgggaagagggtaggcgctgttcttgttacttcacccacctaccatggtgtatgcagcaatgtgcaaggtattgtcagtgtttgtcatccacgaggcattccggttatagttgatgaagcgcatggtgcacatttcaggttccatgacagtttgccaagcactgcaattgagcaaggtgctgacctagctgtgcaatccacacacaaggtcctgtgctcccttacacagtcttcaatgcttcacatgtctggagatcttgtcgatgtagataaagtaagccagtgccttcagctcctccagagctcgagcccgagttaccttctactgtcatctttagatgccgcgagagatcagctgagccagaacacaaatatatttgatgagccattagctatagcatcggaaacaaaagacctgctggcgagaatccctgggatatctgttctagacttaccatgctttgcttctgatttccctgccattgatccgttgcgcatcacactcagtgcctcagatctgcaattatcgggatacgaagccgatgacattttatatgaaggccatcaaatcgtatctgagcttgttggcacaagggccgtgacatttgcagtcaacttaggaaccagagtgcaggacgctgagaagcttgtgcagtctgcaaagcatctatcagaaaaacatttctttgcaaatagcctgaaacccgtgaaggagaatcgtgtgcatggcccattagagaatatctctgtgcatctgagtccaagagaggccttctttacagagaagaggagagtgaaaatcgaggacagccttggtgaaatctgtggtgagctaatatgcccgtatccacctggtatcccagttctgattccaggcgaggtagtaacccatgattcactgtcctacttgatgagcgttagacaccaaggcatcacgatcagtggagcggctgatgctgagctaaattccattctggtgtgcgacttataa

SEQ ID NO: 263 - protein, 485 aa, Zea mays.
MPLVCALQLTARQDVSCFHFPGHNRGKAAPSSLSKLIGSGAFLHDLPELPELDDLFSPKGVILDAQRRAAQLFGSSKTWFLVNGTTCGIQASVMATCSPGDYLIVPRNCHLSVISALVLSGVVPKYIIPEYNSGWDIAGGITPLQLDEAVKELEEDGKRVGAVLVTSPTYHGVCSNVQGIVSVCHPRGIPVIVDEAHGAHFRFHDSLPSTAIEQGADLAVQSTHKVLCSLTQSSMLHMSGDLVDVDKVSQCLQLLQSSSPSYLLLSSLDAARDQLSQNTNIFDEPLAIASETKDLLARIPGISVLDLPCFASDFPAIDPLRITLSASDLQLSGYEADDILYEGHQIVSELVGTRAVTFAVNLGTRVQDAEKLVQSAKHLSEKHFFANSLKPVKENRVHGPLENISVHLSPREAFFTEKRRVKIEDSLGEICGELICPYPPGIPVLIPGEVVTHDSLSYLMSVRHQGITISGAADAELNSILVCDL

SEQ ID NO: 264 - DNA, 1473 bp, Bacillus subtilis
  CDS (1)..(1473)
atgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggtgataaaattattattccaagaaatgttcataaatcaattatgacagctattgtattttccggagcggttccaatttttattcatcctgaaattgacaatgaattgggcatctcccacggaattacacttgaatctgctaaacgggcgcttaccgagcatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattgccgctatcggctatgcaggcaggagcggacatagcagcgacaagtgtacacaagctgggcggatcactgacacaaagctctattttaaacatgagagaaggccttgtatctaaagacagagtgcaatccatcctgagcatgctgacaactacgtcaacttcttacttgcttctcgcttctttggatgttgccagaaaacgccttgcaacagaaggccgccagcttgctgaggaaacactcaagcttgccaatcagacgagagatcgcctcaatcagattgaaggcatttattgtgtcggttctgagattcttgggtcgaaagcagcttacagctatgatccgacaaaattgattatctctgtgaaaagtcttggcctgacaggacatgacgtggaaaaatggcttcgtgaatcctttaatattgaggtggagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaatacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataa

SEQ ID NO: 265 - protein, 490 aa, Bacillus subtilis
MSQHETPLYTGLKKHASRQPVQFHIPGHKKGAGMDPEFRQFIGENALSIDLINIEPLDDLHAPKGIIKQAQDLAAEAFGADHTFFSVQGTSGAIMTMVMAVCGPGDKIIIPRNVHKSIMTAIVFSGAVPIFIHPEIDNELGISHGITLESAKRALTEHPDAKGLLVINPTYFGVAADLKSIVELAHSFDVPVLVDEAHGVHIHFHDELPLSAMQAGADIAATSVHKLGGSLTQSSILNMREGLVSKDRVQSILSMLTTTSTSYLLLASLDVARKRLATEGRQLAEETLKLANQTRDRLNQIEGIYCVGSEILGSKAAYSYDPTKLIISVKSLGLTGHDVEKWLRESFNIEVELSDLYNILCIFTPGDSQNDADRLVEALTEIAQQMSEQDVTHQQTEVLLPEIPLLAMTPRDAFYANTEVIPLKEASGRIIAEFVMVYPPGIPIFIPGEIITEENISYIFKNLDAGLPVQGPEDSTLHMIRVIKEQKAIQ

SEQ ID NO: 266 - DNA, 1452 bp, Synechocystis sp.
  CDS (1)..(1452)
atggtcaacctcaatcaacaagatttgcccctggtcaatgcgttaaaagccctagctcaacaaccggatacgcctttttatgcgccgggccataaaaggggtcagggtatttcccctagttttaaacaatggttggggccaaacctcttccaagctgatctgccggaattgccggaattagataatctctttgctcccaccggggcgatcgccaaagctcaggagttagccgcggatttatggggggcagaacacacttggttttctgttaacggttccaccgccggtattgtggccgcaattttggccacctgtggggatggggataaaattctcttgcctcggaatgttcaccaagcggcgatcgccggcattatccatgctggggcagtgccaatatttttggaaccggaggttaaccccgattgggatttggctttgggggtgacggaggaaactttaagtaaagcattgcaagaacatgacgatgcaaaagcagtatttttgctcaatcctacctaccacggtgttgtgggggacttacaaaaattaattaaattaagtcatagagttaacctacctgtcattgttgatgaagcccacggtgcccattttgctttccatccatccttacccagaccggctttagaattaggggcggatattgtcatccaatccacccataaaatgctgggagctttgagtcaatgtgccatgatccatggccaaggaaacttaattaatcccccaagaattagtcaatgtttgcaattaattcaatccactagtcccaattatgttttattggcttccctcgatgatgcgcggcaccaaatggccaatggcggcagagaaaagatggcggaattattgaattttaccctccattatcgacaacaattaagtcaaattcctgggttaactttattagaaattaccaaacctttgcccggagctttaatcctcgatcccacccgcattaccgtcgatgtcactgcctggggaatgtcaggatttgaggtagatgatttgttacgggaaaagtttcaaattacagcggaattgcccaccctaaggcagttaagttttatcgttagtattggcaatcaagcccaggatttaggacatttattggaagctttaacccagttagcacctacgaatcctcaacaaccttttcacctaactttacccgtcttacccggtactattctggctatgactccccgccgagcggcccatgctgcccaaaaatcggtaaccgttaatgaagcgattgggaaaattagtgctggtctgctttgcccctatccccccggtattcccgtccttgttcccggagaaattatcaccccggaggcgatcgcctttttgacagaagttttaaatttagggggtaccatcagcggtttagctagtgaggaattaacccatttggctgtggtgaattaa

SEQ ID NO: 267 - protein, 483 aa, Synechocystis sp.
MVNLNQQDLPLVNALKALAQQPDTPFYAPGHKRGQGISPSFKQWLGPNLFQADLPELPELDNLFAPTGAIAKAQELAADLWGAEHTWFSVNGSTAGIVAAILATCGDGDKILLPRNVHQAAIAGIIHAGAVPIFLEPEVNPDWDLALGVTEETLSKALQEHDDAKAVFLLNPTYHGVVGDLQKLIKLSHRVNLPVIVDEAHGAHFAFHPSLPRPALELGADIVIQSTHKMLGALSQCAMIHGQGNLINPPRISQCLQLIQSTSPNYVLLASLDDARHQMANGGREKMAELLNFTLHYRQQLSQIPGLTLLEITKPLPGALILDPTRITVDVTAWGMSGFEVDDLLREKFQITAELPTLRQLSFIVSIGNQAQDLGHLLEALTQLAPTNPQQPFHLTLPVLPGTILAMTPRRAAHAAQKSVTVNEAIGKISAGLLCPYPPGIPVLVPGEIITPEAIAFLTEVLNLGGTISGLASEELTHLAVVN

SEQ ID NO: 268 - DNA, 1476 bp, Bacillus halodurans
  CDS (1)..(1476)
atgtctcgtcaagaacagacccccctcttctcgggagtcgttgctcacgctaaacataaccctgtacaatttcatattcccggtcataaaaaaggagctggtatggacccagcgttccgttcatttatcggtgacaatgctctatcgatcgatttaatcaatataggcccgcttgacgatctacatcatccccatgggatcattaaagaagcacaagagttagccgccgaagcatttggggcagatcatacgtttttttctgtccaagggacaagcggtgccatcatgacgatgattatgtccgttgtcgggcctggtgaaaagatcatcgtgccacgaaatgttcacaagtcgatcatgtctgcgatcgttttttcaggagcgacacctgtgttcatccatccagaaatcgatccccttctagggatttcccatggaatcacgattgaagcggtggaaaaggcgcttgacgctcaccctgatgccaaaggacttcttgttattaacccgacatactttggcattgctgcaaacttaaaaaaaattgtagagctttgccatagcagggacgttcctgttcttgtcgatgaagcgcatggggtgcacattcatttccatgaagcccttcccttatcggcaatgcaggccggagctgatatggcggcaacgagtgttcataagcttggaggttccttgacacagagctccattttaaatgttcgcgaaggcctcgtctctgcgaagcgtgtgcaaacgattataagtatgctaacaacaacctccacgtcctatttgctcctcgcctcccttgatgcggcgagaaagcatttagcgacaaacggtagagatcttattggctataccattcagttggctgatcaggcaagagatcaaattaacgccattgatggcttgtactgtgtcggcaaggagattcttggaacgattgctacctatgattacgatccaacgaaactgatcatttctgtgaagaatcttggaattactggctacgatgcagaagtatggttaagggaacattatcagatcgaggttgagctgtcagatctatataatattctttgcatcgtttcctttggtgacactgagcgggagatggatctgcttgtcaaagctctctctgagctggctgacctgcacaaacatgggatttgtgaacggagtccagtctctgtctacgttccaaatatccctacactcgccatgtctccgcgagatgccttttatgctgaaactgaggtcgttccattcgaagattctgtcggacgtaccattgcagaatttattatggtttaccccccaggaattccaatcctaattcctggtgaaattataaccgaaagcaatctcgcctacattcgtgaaaacaaccgtgccggtcttcctgtgcaaggtccagaagacgacacctttcgaacgttgcgtgtcataaaagagcacgaagccatccgttaa

SEQ ID NO: 269 - protein, 491 aa, Bacillus halodurans
MSRQEQTPLFSGVVAHAKHNPVQFHIPGHKKGAGMDPAFRSFIGDNALSIDLINIGPLDDLHHPHGIIKEAQELAAEAFGADHTFFSVQGTSGAIMTMIMSVVGPGEKIIVPRNVHKSIMSAIVFSGATPVFIHPEIDPLLGISHGITIEAVEKALDAHPDAKGLLVINPTYFGIAANLKKIVELCHSRDVPVLVDEAHGVHIHFHEALPLSAMQAGADMAATSVHKLGGSLTQSSILNVREGLVSAKRVQTIISMLTTTSTSYLLLASLDAARKHLATNGRDLIGYTIQLADQARDQINAIDGLYCVGKEILGTIATYDYDPTKLIISVKNLGITGYDAEVWLREHYQIEVELSDLYNILCIVSFGDTEREMDLLVKALSELADLHKHGICERSPVSVYVPNIPTLAMSPRDAFYAETEVVPFEDSVGRTIAEFIMVYPPGIPILIPGEIITESNLAYIRENNRAGLPVQGPEDDTFRTLRVIKEHEAIR

SEQ ID NO: 270 - DNA, 1449 bp, Bacillus halodurans
  CDS (1)..(1449)
atgaaaaaagcctcaacattgccgctatttgaacggctcgttcagcatgatcgcgggggacctatctcgtgccatgttccaggccataagcagggggctctttttcataaggatgcctgttcatattttcaaagcattttatcccttgatgtaacggagctaaccggccttgatgatctccatgatcccagaggagttattgcagaggctcaagctttgacagcccgctacgtcggggcagaagcgacgtgttttttagtcaatggctcgacggttggtaatttggcaatgattttaggtacacttgagcctggcgatactgtttttgtacaaagggattcgcataaatcggtgatgaatgggttagcgatggcaagggtccatccaatctttctttcaccatcctacgatgagagaacgcaattaccaacaggtattaccgaacaaacgttaaaacaagcactaatagaacacccgaatgggaaagcacttattttaacatatccatcgtattatggggttgcccgctcgatccgtccgctcgtccagatggcgaaagaagctggattgtacgtacttgtggatgaggcgcacggagcacattttccggtaggtgatccatttccgaaacaagcacttgagcaaggggccgacgtagtcgttcaatctgcgcataaaaccttacccgccttaacaatgggctcctatcttcactttgctcatggactacattcgaaaatcaaggattccattcgagagcaattgcagattttgcagtcgagcagcccatcctatccgattcttgcctcattagatgcagcaagaggatttttagaggatctcacgaatgtaaaagatacgctcgattccatcgcggagatgaataggcggattgaacaggtcgagcgtttgtcggttgctacattttccccgctacccaccgatccattaaaaacggtgattacagtagaaggggcaacaggatttgccttgcaaaccgaacttgaaaaagaggggatatactcagagctggcagacgatcgtcatgttttgcttatgtgggggctaacccctttacagaaagtccgacaagaggaaatcatcgacaaaatgtgccgagcaaccaagcggcttcctgcgcttgagcaaataagtaaagggtgccccctatcgttatcgtggcaagcacacacgtcgcttgatctatcatatgatgaacaaaaacgatattcaattgaagaggttgccgtggaagaggctgtggggaaagtgagtggagcaacggttatcccttatcccccaggggtacctctcctattaaaaggggaaaaaatcacagaaccgttaattgcccaatttcagcagttgcaggaggcaggggcccgttttcaggggagaccttctgagcaacaagggttgtatgtgtttacgttggaggctatgacataa

SEQ ID NO: 271 - protein, 482 aa, Bacillus halodurans
MKKASTLPLFERLVQHDRGGPISCHVPGHKQGALFHKDACSYFQSILSLDVTELTGLDDLHDPRGVIAEAQALTARYVGAEATCFLVNGSTVGNLAMILGTLEPGDTVFVQRDSHKSVMNGLAMARVHPIFLSPSYDERTQLPTGITEQTLKQALIEHPNGKALILTYPSYYGVARSIRPLVQMAKEAGLYVLVDEAHGAHFPVGDPFPKQALEQGADVVVQSAHKTLPALTMGSYLHFAHGLHSKIKDSIREQLQILQSSSPSYPILASLDAARGFLEDLTNVKDTLDSIAEMNRRIEQVERLSVATFSPLPTDPLKTVITVEGATGFALQTELEKEGIYSELADDRHVLLMWGLTPLQKVRQEEIIDKMCRATKRLPALEQISKGCPLSLSWQAHTSLDLSYDEQKRYSIEEVAVEEAVGKVSGATVIPYPPGVPLLLKGEKITEPLIAQFQQLQEAGARFQGRPSEQQGLYVFTLEAMT

SEQ ID NO: 272 - DNA, 1443 bp, Bacillus subtilis
  CDS (1)..(1443)
atgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttctggggtgattaaggaagctcaggagcttgccagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttgtccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgccagccatgacgatgggttcttatttgcatctcaacagcagctgcaggattaacagggatcgggtggcagagtatttaaaccgattacaaagcagcagcccgtcttatccgattatggcttcgttagatattgcccgcgcttatgtacagcatattatagaagaacaaaagctttctgacattctgcagcggatagaaacacttaaacaaacgtttgattcacttacaaatgcagaagctgttaaccctgctaatccactgatcatcacggatccgctaaagctcacaattcgttcaaaacgcgggcattctggctatacgctgcaaagcattttagagcgtgccaacatattcactgagcttgctgatgaaaatcaagttctgctcgttctcccattgggaggaaaacggagaataaacgctgaaatcattagaagcatcgatgaagagattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggcttaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcataa

SEQ ID NO: 273 - protein, 480 aa, Bacillus subtilis
MNTPLYKALIQHARRNSHSFHVPGHHNGDVFFDDAKSIFDPLLTIDVTELAGLDDLHHPSGVIKEAQELASQLYGSAESFFLVNGTTVGNLAMILSVCEPGDTILVQRNCHKSVFHAVDLSGAEPVYLAPDVDSAMHVPTHVPLGTIKEALEAYPDAKGLVLTNPTYYGHSADLTEIITEAHHYGIPVLVDEAHGAHFILGEPFPVSALKMGADIVVQSAHKTLPAMTMGSYLHLNSSCRINRDRVAEYLNRLQSSSPSYPIMASLDIARAYVQHIIEEQKLSDILQRIETLKQTFDSLTNAEAVNPANPLIITDPLKLTIRSKRGHSGYTLQSILERANIFTELADENQVLLVLPLGGKRRINAEIIRSIDEEIEKTPPDQTFVSAEWGVQPVTVLPYPKKVLHSFKKEYVSFEEAAGRLNAEDIIPYPPGIPMIMAGERITKESVQKLSRLISMKTHVQGNMKIKEKQLLVYIEEEKS

SEQ ID NO: 274 - DNA, 1476 bp, Streptococcus pneumoniae
  CDS (1)..(1476)
atgaaagagttagatcaaaaccaagccccaatttatgaggccttggtgaagttacgcaagaaaaggattgttccctttgatgttccaggtcacaagcgtggacggggaaatccagaacttgtcgaactcttaggagaaaaatgtgtaggcattgatgtcaattcgatgaaacctttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccacggagcgcatttgcatttcactgataaacttccaatttctgctatggatgcaggggctgatatggcagcagtttccatgcataagtctggtgggagtttgacccaaagctccattttacttatcggggagcagatgaattctgaatacgttcgtcagataattaacctgacccagtctacatctgcctcttacttgttgatggctagtttggatatttcacgtcgcaacttggcccttcgtggtaaagagtcgtttgagaaagtcattgagctatctgagtatgcccgccgtgaaatcaatgctatcggtggctactatgcctactcaaaagagttaatagacggtgtttcggtttgcgattttgacgtaactaagctgtcagtttacactcagggtattggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcaagagatggaaaagatttgatagcaggagaatatattcagcccgagttagtgctgtctccgcaagaagccttctattcagaaagaaaaagtttaactttggatgattctgttggacaggtctgtggagaatttgttatgtgttaccctccaggtattcctatcttggctcctggtgaacgcattacacgagaaattgtcgactatatccaattcgccaaggaacgtggttgctccctccaagggacggaagatccagaggtcaatcatatcaacgttattaagagaaagacaaactataagaaaagtcaataa

SEQ ID NO: 275 - protein, 491 aa, Streptococcus pneumoniae
MKELDQNQAPIYEALVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTDKLPISAMDAGADMAAVSMHKSGGSLTQSSILLIGEQMNSEYVRQIINLTQSTSASYLLMASLDISRRNLALRGKESFEKVIELSEYARREINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDDSVGQVCGEFVMCYPPGIPILAPGERITREIVDYIQFAKERGCSLQGTEDPEVNHINVIKRKTNYKKSQ

SEQ ID NO: 276 - DNA, 1446 bp, Clostridium acetobutylicum
  CDS (1)..(1446)
atgtctaagacaccaatcatagatggaataatgaaatatataagtgaaaagaataatctgttttgcactccagggcataagggaggcagaggattcgcaaatagcgaaggtggcagaagcttatatgaaaatatcataaagatagatttaacagaagttgatggacttgataacttacatgatcctcaaggaattatcaaggaatcagaagagagacttagagatttatatgaaagtaaaaaatcatattttcttgttaacggaagtacaagtggtaatctcgctatgatattttcatgttttaatgagggagacaaggtaatagttgaaagaaattgccataaatctatatttaatggaattatacttaggaagcttaatcctgtgtatataaaaaattactttgacgaggatataaatgctcctttatctatagatgaggagtattttttcaagattataagagaaaatatggatgcaaaagggataatacttacatatcctaattactatggagtatgctgtgaccttgaagctatagtgagagaggcaaaaaaatataatatgaaggtattagttgactctgctcatggcgctcattttggtatatcagagaagttaccagaaagtgctgttaagttaggagcagatatggttgttatgagttgtcataaaacgcttccgagtttcacacaaactgcatttcttcatttatgtggagatgtcgaggaaagcaaagttgatttttatgtaagttcatttttgagtacaagcccatcgtatatgtttatgagctcaatggattatgctagatgctatcttgaggaaagaggaaagcatgattatgataacctggtagatttatgtataaagtattcaaaaaagattaatgaaatcaatggattgcatgtattaggtaagagtgatttaaggataaatggtaaggtgcttaattttgatgcaacaagattagttatcaatgtagaggatggttgcagtgggtttaaattatatacgtatttaaaagaaaatagaatacaacctgaaatgtgcgatcatagaaatgttgttttaatttgttcaccatttgacggagaattgcagttacaaaacttatataatacacttagaaaatgcaatattataaaattaaatgacgataataaggtatctgtgcttttgtcatctatgccagaaaataaatttgccccgtatgaggtattgaatttagaaagtgaaaagatcaatattaaagatagtgtgggaaaagtgtgtaaaaaagcattagtgccatatccacctggaataccggtgattatgccaggagaagtaataaatgaaaatgttgttgatattatattgaaagctgttaaagataacattacagttttaggaattgaaaatcgaaataaagaaattaccatagatgtagtttgtgaagactaa

SEQ ID NO: 277 - protein, 481 aa, Clostridium acetobutylicum
MSKTPIIDGIMKYISEKNNLFCTPGHKGGRGFANSEGGRSLYENIIKIDLTEVDGLDNLHDPQGIIKESEERLRDLYESKKSYFLVNGSTSGNLAMIFSCFNEGDKVIVERNCHKSIFNGIILRKLNPVYIKNYFDEDINAPLSIDEEYFFKIIRENMDAKGIILTYPNYYGVCCDLEAIVREAKKYNMKVLVDSAHGAHFGISEKLPESAVKLGADMVVMSCHKTLPSFTQTAFLHLCGDVEESKVDFYVSSFLSTSPSYMFMSSMDYARCYLEERGKHDYDNLVDLCIKYSKKINEINGLHVLGKSDLRINGKVLNFDATRLVINVEDGCSGFKLYTYLKENRIQPEMCDHRNVVLICSPFDGELQLQNLYNTLRKCNIIKLNDDNKVSVLLSSMPENKFAPYEVLNLESEKINIKDSVGKVCKKALVPYPPGIPVIMPGEVINENVVDIILKAVKDNITVLGIENRNKEITIDVVCED

SEQ ID NO: 278 - DNA, 1464 bp, Clostridium acetobutylicum
  CDS (1)..(1464)
atgtataaattaaatcaaaatgaaacaccactttttaacgctttgatggaatatgtaaatagagatactattccctttcacgtaccaggacataaaaaaggtaatggaattgataaggaattcaaaaactttatcggtgagaacccttttaaaattgatgtaactgtattcaaattggtagacagcttacaccaccctacaggtcctataaaaaaggctcaagaattagctgctgatgcctacggttccaaggctgctttttattctgtaaacggaacttctggagctatacaaggtatgattctatctgtagtaggtgatggagataaaataatagtgcctagaaacgttcataaatctgtaactgccggaatcattctaagtggtgctgtacctgtatatatgcatccagaagtcgatagaagagttggaatagcccatggtgtatctccagaaactgttggagaaactcttaaaaataatcctgatgcaaaggctgtacttcttataaatcctacatattacggagtatctacagatataaaaaaaatagctgatatagttcacagctatgatatacctctcatcgttgatgaggctcatggacctcatttgagttttaatgatagacttcctgtatcagctttgaaagccggagcagatatgtgtgctcaaagtacacataaaataataggtgctcttactcaaatgtctcttctacatgtaaactcagatagaatagatatgaacagagttcagcaaataatgaatctacttcaaaccacatcaccatcctacatattgatggcttctatggattgcgctagacgacaaatagctcttcacggaaaggaactattagatggcacaatagatttatgcaattatgcaaggcgtgaaataaataaaatacctggcttctattgctttggtgaagaagttttagggaaacccggatcatatgctttcgatccaactaagcttacaattacctgcactgatttaggaataacaggttatgatcttgatatgcttttagccaatgattaccacatacaagtggagctttctgatttatataatgtacttgctgtgggttcttttggtgatacaaaagagaatattgatgctttaattaatgctttaagacaaataagcaaaagtatttcttcaactgttaaaaataagaagaattcatttatcgatattcccgatgtacccgagagaatactttcacctagagatgcatttaatggtgcaaaggaatccatgctaattaaagacagcgtaggtaaaacaagcggagaatttttaatggcttatccgccaggcatacctgtactatgtccaggagaaattataacccaggaaataattgactacgtcagcgacttaaaagctgctggtctatatgttcaaggaacagaagatcctgatgtaaattatataaaggtactaaaataa

SEQ ID NO: 279 - protein, 487 aa, Clostridium acetobutylicum
MYKLNQNETPLFNALMEYVNRDTIPFHVPGHKKGNGIDKEFKNFIGENPFKIDVTVFKLVDSLHHPTGPIKKAQELAADAYGSKAAFYSVNGTSGAIQGMILSVVGDGDKIIVPRNVHKSVTAGIILSGAVPVYMHPEVDRRVGIAHGVSPETVGETLKNNPDAKAVLLINPTYYGVSTDIKKIADIVHSYDIPLIVDEAHGPHLSFNDRLPVSALKAGADMCAQSTHKIIGALTQMSLLHVNSDRIDMNRVQQIMNLLQTTSPSYILMASMDCARRQIALHGKELLDGTIDLCNYARREINKIPGFYCFGEEVLGKPGSYAFDPTKLTITCTDLGITGYDLDMLLANDYHIQVELSDLYNVLAVGSFGDTKENIDALINALRQISKSISSTVKNKKNSFIDIPDVPERILSPRDAFNGAKESMLIKDSVGKTSGEFLMAYPPGIPVLCPGEIITQEIIDYVSDLKAAGLYVQGTEDPDVNYIKVLK

SEQ ID NO: 280 - DNA, 1476 bp, Streptococcus pneumoniae
  CDS (1)..(1476)
atgaaagagttagatcaaaaccaagccccaatttatgagtccttggtgaagttacgcaagaaaaggattgttccctttgatgttccaggtcacaagcgtggacggggaaatccagaacttgtcgaactcttaggagaaaaatgtgtaggcattgatgtcaattcgatgaaacccttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatatgttcagacctaaaggggttgacagaaatggctcatgaagctggcatgatggttttagtagatgaagcccatggagcgcatttgcatttcactggtaaacttccaatttctgctatggatgcaggagctgatatggcagcagtttccatgcataagtctggtgggagtttgacacaaagttcgcttcttttaatcggggagcagatgaatcccgagtacgttcgtcagattataaacctgacacagtctacatctgcctcttacttattgatggctagtttggatatttcacgtcgcaacttggcccttcgtggtaaagagtcgtttgaggaagtcattgagctatccgagtacgctcgtcatgaaatcaatgccattggcggttactatgcttactcaaaagagttaatagatggtgtgtcggtctgtgattttgatgtaaccaagttgtcagtttacactcagggaataggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcacgagatgggaaggacttaatagctggagaatatattcagcccgagttggtgctgtctccacaagaagccttctattcagagagaaaaagtttgaccttagatgagtctgttggacaggtctgtggagaatttgtcatgtgctatcctccagggattcctatcttggctcctggtgaacgcattacacgagaaattgtagactatatccaattcgccaaggaacgtggttgctccctccaagggacggaagatccagaggtcaatcatatcaacgttattaagagaaagacaaactataagaaaagtcaataa

SEQ ID NO: 281 - protein, 491 aa, Streptococcus pneumoniae
MKELDQNQAPIYESLVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTGKLPISAMDAGADMAAVSMHKSGGSLTQSSLLLIGEQMNPEYVRQIINLTQSTSASYLLMASLDISRRNLALRGKESFEEVIELSEYARHEINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDESVGQVCGEFVMCYPPGIPILAPGERITREIVDYIQFAKERGCSLQGTEDPEVNHINVIKRKTNYKKSQ

SEQ ID NO: 282 - DNA, 1380 bp, Listeria innocua
  CDS (1)..(1380)
atgcgagatcaatctaaaatgcctttagtggaacggttagatgctcatgctaaatcctgcccaatatcactccatgttccaggacacaaaagtggagccatttatccagctgtatggcaaaatttattaaaatgggatgtaacagaaatcaccgggatggacgacttacatcacccagaagacgtgattttggaagcagaggagttactttctgaatgctatggaagtaaaaaaagctattttctagtcaatgggacaagcggaggaagcttggcggttattatggcgacgttaaagcgcggggagaaagttttagtgccaagagatgcacataaatcaatcttgcatggcatcgaactcgccggtggaaaaccgattttcttaactccggcaaccaataaagaagtcggcgtcgcgagtggcgtgacaaccgaacttctggaagaaaccttacataatcacccagatataaaactatgtattttcacttatccgagctattatggaacgacttttaatttagaaaaatgtattcgaattgcgcatcaatatggcgcggttgtgtttgtcgatgaggcgcacggggcacattttttaacgagctctgagtttccaaaaagtgcagtggagcttggtgcggatgtagttgttcagtcggcgcataagacgctaccggcgctaacgatgggatcctatttacatgtcgtgaatgatttaccggtttttgaaaaactagcttattatctgcaagtatttcaaacgagtagcccatcttatttaatcatggcgtcactggatgcggcgcggaaatatgcggcaacttacacagcagcagacgtcgaagctttttggaaaatgcgtgctagatggattaaatggctaacgaagaataaatttgaagtcattttgccagatgatccacttaaaatcatcgtccgcaaaacaggctacacgggctacgaattgcaaacgatttttgaagaaagttcttattttccagagcttgccgacgagtcacaggtattactgattttaccattaatcaaaaaagggattgatttcacgccaattagtcggattcattctccatcgaaaaaagaaatcgcgaaacaaccatatgaaatgtcagcgccttttgcgtcaggtcttgcgttaacttacgaagaaatgcacgcccgcgcgaccgaatttgtgtcattagatgaagctacgacacgcgtttcggctgaaacaatctcgctttatccgccgggaatcccagctattatccgcggagaaagtatcacagaaaaacatatccgcgaactaaaaagtattcgctcgcggcactaccaaggcggcgaaaaactagccgagaattacatccgtatattccgctaa

SEQ ID NO: 283 - protein, 459 aa, Listeria innocua
MRDQSKMPLVERLDAHAKSCPISLHVPGHKSGAIYPAVWQNLLKWDVTEITGMDDLHHPEDVILEAEELLSECYGSKKSYFLVNGTSGGSLAVIMATLKRGEKVLVPRDAHKSILHGIELAGGKPIFLTPATNKEVGVASGVTTELLEETLHNHPDIKLCIFTYPSYYGTTFNLEKCIRIAHQYGAVVFVDEAHGAHFLTSSEFPKSAVELGADVVVQSAHKTLPALTMGSYLHVVNDLPVFEKLAYYLQVFQTSSPSYLIMASLDAARKYAATYTAADVEAFWKMRARWIKWLTKNKFEVILPDDPLKIIVRKTGYTGYELQTIFEESSYFPELADESQVLLILPLIKKGIDFTPISRIHSPSKKEIAKQPYEMSAPFASGLALTYEEMHARATEFVSLDEATTRVSAETISLYPPGIPAIIRGESITEKHIRELKSIRSRHYQGGEKLAENYIRIFR

SEQ ID NO: 284 - DNA, 1380 bp, Listeria monocytogenes
  CDS (1)..(1380)
atgagaaatcaatctaaaatgcctttagtggaacggttagatgctcatgctaagtcttgcccaatatcactccatgttcctggacacaaaagtggagcaatttatccagatgcatggcaaaaattattgaaatgggatgtaacagaaattactggaatggacgatttgcaccaccctgaagatgtgattttggaagcagaagagttacttgcggaatgttatggaagtaaaaaaagctattttctagtcaacggaacaagcggaggaaacgtggcggttattatggcaactttaaagcgtggggagaaagttttagtgccaagagatgcgcataaatcaatcttgcatggtatcgaactggcaggcggagaaccgattttcttaaccccagcgacaaataaagaagttggcgtcgcgagtggtgtgacaaccgaacttctcgaagaaacattacataatcacccagatgtaaaactatgtattttcacttatccgagctactacggaacgacttttaacttgcaaaaatgtattcgaattgcgcatgattttggcgcggttgtatttgttgatgaagcgcacggagcccattttttaacaagttctgaatttccgaaaagtgcagtggagcttggtgcggatgtggttgttcagtcggcgcataagacgttgccggcgctaacgatgggatcctatttacatgtcgttaatgatttaccgatttttgaaaaactagcttattatctgcaagtattccaaacgagcagcccgtcttatttaattatggcgtcactagatgcggcgaggaaatatgtggcaacttacacagcggcagacgtcgaagctttttggaaaatgcgtgccagatggattaaatggctaacgaagaataaatttgaagtcattttgccagatgatccacttaaaatcatcgtgcgcaaaacaggctacacggggtacgaactgcaagccatttttgaagaaagttcttatttcccagagcttgccgacgagtcgcaagtgttactgattttaccattaatcaaaaaaggaattgatttcacgccaatcagccggattcattcaccgatgaaaaaagaaatcgcgaaagagccgtacgaaatgtcgacaccttgcgcgtcaggtcttgctttaacttatgaagaaatgcacgcacgcgcgaccgaattcgtattactagatgaagctacgacacgcgtttcggctgaaacaatctcgctctatccgccgggaattcccgcaatcatccgcggagaaggcatcaccgaaaagcatatccgcgaactaaaaaacattcgcacacgccactaccaaggcggcgaaaaactagccgagaattacatccgtgtattccgctaa

SEQ ID NO: 285 - protein, 459 aa, Listeria monocytogenes
MRNQSKMPLVERLDAHAKSCPISLHVPGHKSGAIYPDAWQKLLKWDVTEITGMDDLHHPEDVILEAEELLAECYGSKKSYFLVNGTSGGNVAVIMATLKRGEKVLVPRDAHKSILHGIELAGGEPIFLTPATNKEVGVASGVTTELLEETLHNHPDVKLCIFTYPSYYGTTFNLQKCIRIAHDFGAVVFVDEAHGAHFLTSSEFPKSAVELGADVVVQSAHKTLPALTMGSYLHVVNDLPIFEKLAYYLQVFQTSSPSYLIMASLDAARKYVATYTAADVEAFWKMRARWIKWLTKNKFEVILPDDPLKIIVRKTGYTGYELQAIFEESSYFPELADESQVLLILPLIKKGIDFTPISRIHSPMKKEIAKEPYEMSTPCASGLALTYEEMHARATEFVLLDEATTRVSAETISLYPPGIPAIIRGEGITEKHIRELKNIRTRHYQGGEKLAENYIRVFR

SEQ ID NO: 286 - DNA, 1467 bp, Nostoc sp. PCC 7120
  CDS (1)..(1467)
atgcttgatcaaaaccaaacaccactaatagaatctataaaagcttgtactgctcgacatcatgcagcgttttatactcctgggcataagcaggggagggggattgctcaacctttggctgatttgttgggtaaagcggtatttagtgctgatttgacggagttggctgatttagataatttatctgcgccccaaggagtgattcaggaagcccaacaattagcggcggcggcgtttggtgcctcacagacatggtttttggtcaatggttctacttgcggtgtcgaggcggcaattctggctacttgtagaccgggggataaaattattttgcctcggaatgtacattcatcggcgatcgctggtttaattctctctggtgctatcccgatttttatttatcctgaatatgacccagttttagatatcgcccatagcatcacgcctgaggctgtaaaagcagctttgcaacaacatcctgatgctaaagcggtgttgacagtttaccctacatattacggtgtatgtggggatttagaggcgatcgcccaagtcacccaccactacaatattcctttactagtagatgaagcccacggcgcacacttcgcttttcacccagaattacccacctcggccttagccgcaggtgcagatttaactgtacagtcgattcacaaggtactgggtgcaatgacgcaagcttcaatgcttcacatccaaggtgacagaataaatgcggttcgagttagtcaggctttgcagctgctacagtctactagccccagttatgtacttctagcttccctggatgcggctcgtcaacaaatggctttgtctggtaaacagttaatgtcccgtaccttacaactagcgaatgaagccagagaaagaattagtcaaattcctggcttatcagttttacagcctcctaccaagacaccatcaccagggtttacaactttggataaaacacgcttaactgtgactgtttccggcttgggtttaacgggttttgcggcggaagaaattttagatgaacaactgggggtaacggctgaatttgctacgttgcaacatctcacctttattattagcttgggaaacacagctactgatattgagcagttagtccaaggtttcacaactttagcagaaacaacactgcctactaaggcattagtcaacccaaaagttaatagtaatctggaatatttttcagaaatttctccccgtgatgccttttttgccgatagtgaaacgttatccatcgaacaggcgtgcgatggcatttgtgcagaaattgtctgtccttatcccccaggaatccccgtccttatgccaggagaagttatcacaaaacccgccattgaatatttgcaacatatccaaagtttaggcggattcattactggttgtgccgatactagtctgaatactttaaaagttttagtcaatagtcattaa

SEQ ID NO: 287 - protein, 488 aa, Nostoc sp. PCC 7120
MLDQNQTPLIESIKACTARHHAAFYTPGHKQGRGIAQPLADLLGKAVFSADLTELADLDNLSAPQGVIQEAQQLAAAAFGASQTWFLVNGSTCGVEAAILATCRPGDKIILPRNVHSSAIAGLILSGAIPIFIYPEYDPVLDIAHSITPEAVKAALQQHPDAKAVLTVYPTYYGVCGDLEAIAQVTHHYNIPLLVDEAHGAHFAFHPELPTSALAAGADLTVQSIHKVLGAMTQASMLHIQGDRINAVRVSQALQLLQSTSPSYVLLASLDAARQQMALSGKQLMSRTLQLANEARERISQIPGLSVLQPPTKTPSPGFTTLDKTRLTVTVSGLGLTGFAAEEILDEQLGVTAEFATLQHLTFIISLGNTATDIEQLVQGFTTLAETTLPTKALVNPKVNSNLEYFSEISPRDAFFADSETLSIEQACDGICAEIVCPYPPGIPVLMPGEVITKPAIEYLQHIQSLGGFITGCADTSLNTLKVLVNSH

SEQ ID NO: 288 - DNA, 2220 bp, Hafnia alvei
  CDS (1)..(2220)
atgaatatcattgccatcatgaacgatttaagcgcttattttaaggaagaacccctgcgcgagctgcatcaagagttagagaaggaaggcttccgtattgcttatcccaaagaccgcaacgatctgctgaagctgattgaaaacaactcccgcctgtgtggcgtcattttcgactgggataaatataacctcgaactcagcgctgaaatcagcgagctcaacaaactgctgccaatttatgccttcgccaatacctattcgacgcttgacgtcaacatgagcgacctgcgtcttaatgttcgcttctttgaatatgcattaggcagcgcgcaagacattgccaccaagatccgccaaagcaccgatcagtatattgataccattctgccaccgctgaccaaggcgctgttcaaatacgtcaaagaagagaaatacacagtctgtacgccggggcatatgggcggaactgcgttcgataaaagccctgtcggtagcctgttctatgatttcttcggtgaaaacaccatgcgttcggatatctcgatctccgtatctgagctcggatcgctgctcgatcatagcggcccacaccgtgacgccgaagagtatatcgcgcgcacgttcaacgccgatcgcagctatatcgtaaccaacggaacatctacggcgaataaaattgtcggcatgtattcatctcctgccggtgccactattctgatagaccgtaactgccataaatcattgacccatttgatgatgatgagcaacgttgtccccgtctatctgcgcccaacccgtaacgcctacggcattttaggcgggataccgcaaagcgagttcacccgcgccagcattgaagagaaagtgaaaaatacgcccaatgcgacatggccggtgcatgcggtagtcaccaactctacctatgacggcctgttctacaataccgaatacatcaaaaacacgcttgatgttaagtcgattcacttcgattcggcatgggtgccttacaccaacttccatccgatttaccaaggcaaagcagggatgagcggtgaacgtgtgccggggaaaatcatctacgagactcagtccacccacaaactgctggcggcattctcgcaggcatcgatgatccacgtgaaaggtgagatcaacgaagaaaccttcaatgaagcctatatgatgcatacctcaacatcaccgcattacgggatcgttgcgtcgacggaaaccgcggcggctatgatgaagggcaacgccggtaagcgtttaattaacggttcaattgaacgagcgatccgcttccgtaaagagatccgccgcttacgtacagaatctgatggctggttctttgacgtatggcagccggataacattgacgaggttgcttgctggccactcaatccacgtaatgaatggcatggattcccgaacatcgacaacgatcatatgtatcttgatccgatcaaagtcactctgctgaccccaggtttaagccccaatggcactctggaagaggaagggataccggcgtcgatcgtgtcgaaatatctggatgagcacggcatcatcgtggaaaaaaccgggccatataacctgctcttcctgtttagtatcgggatcgataaaaccaaggcgttgagcttgttgcgggcattaaccgatttcaaacgcgtgtatgacctcaacctgcgcgtgaaaaacgtgttgccatcgctctataacgaggcgcctgatttctataaagagatgcgaattcaggagttggctcaggggattcatgctctggtgaaacaccacaatctaccagacctgatgtatcgtgcatttgaggtattaccaaagctggtgatgacgccgcatgatgcgttccaagaagaagtgcgtggcaatattgagccatgtgccttggatgatatgttagggaaagttagcgccaacatgatcttgccgtatcctccgggtgttccggtggttatgccgggagaaatgctcactaaggagagccgccctgttctgagcttcttgcagatgctatgtgaaattggcgcacactatccgggctttgaaacggatattcacggcgttcatcgtgatggtgcaacgggtaaatacatggtcgtggtgctcaaacaaggcgcagatgaaccgggtgataaaccgagtgatacggtgaagaaagcgccgggtaaaaaaccatcagcggcgaagaagtcataa

SEQ ID NO: 289 - protein, 739 aa, Hafnia alvei
MNIIAIMNDLSAYFKEEPLRELHQELEKEGFRIAYPKDRNDLLKLIENNSRLCGVIFDWDKYNLELSAEISELNKLLPIYAFANTYSTLDVNMSDLRLNVRFFEYALGSAQDIATKIRQSTDQYIDTILPPLTKALFKYVKEEKYTVCTPGHMGGTAFDKSPVGSLFYDFFGENTMRSDISISVSELGSLLDHSGPHRDAEEYIARTFNADRSYIVTNGTSTANKIVGMYSSPAGATILIDRNCHKSLTHLMMMSNVVPVYLRPTRNAYGILGGIPQSEFTRASIEEKVKNTPNATWPVHAVVTNSTYDGLFYNTEYIKNTLDVKSIHFDSAWVPYTNFHPIYQGKAGMSGERVPGKIIYETQSTHKLLAAFSQASMIHVKGEINEETFNEAYMMHTSTSPHYGIVASTETAAAMMKGNAGKRLINGSIERAIRFRKEIRRLRTESDGWFFDVWQPDNIDEVACWPLNPRNEWHGFPNIDNDHMYLDPIKVTLLTPGLSPNGTLEEEGIPASIVSKYLDEHGIIVEKTGPYNLLFLFSIGIDKTKALSLLRALTDFKRVYDLNLRVKNVLPSLYNEAPDFYKEMRIQELAQGIHALVKHHNLPDLMYRAFEVLPKLVMTPHDAFQEEVRGNIEPCALDDMLGKVSANMILPYPPGVPVVMPGEMLTKESRPVLSFLQMLCEIGAHYPGFETDIHGVHRDGATGKYMVVVLKQGADEPGDKPSDTVKKAPGKKPSAAKKS

SEQ ID NO: 290 - DNA, 2199 bp, Escherichia coli
  CDS (1)..(2199)
atgtcaaaattaaaaattgcggttagtgattcttgcccggactgttttaccacgcagcgagaatgtatctacattaatgaaagtcgtaatatcgatgtggcggcaatagttttatcgctcaacgatgttacatgcggaaaactcgatgaaatcgatgccacgggttatggcatcccggtatttattgctactgaaaatcaagaacgtgtacccgcagagtatttgccccgtatttcgggtgtctttgagaattgcgaatcgcgacgagaattttatggtcgccagttagaaaccgctgccagccattatgaaactcaactgcgcccacctttcttccgcgcactggtcgattatgtcaatcaaggtaacagcgcgtttgattgccctggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcggcaaaagtgtttaatgccgataaaacctacttcgttttaaatggcacttcatcttctaacaaagtggttttaaacgccctgctaacaccgggtgatctggtgctgtttgatcgcaataaccacaaatctaaccaccacggagcgttgctacaggctggtgcaacaccggtttatctggaaacggcacgtaacccgtatggctttatcggtggcattgatgcgcactgttttgaagaaagttacctgcgtgagctgatcgcggaagtcgcaccgcagcgggcaaaagaggctcgtcctttccgcctcgctgtgattcagttaggcacctacgacggtacgatttataacgcccgccaagtggtggataaaattggtcatctgtgtgactacatcctgtttgactcagcatgggtcggctatgaacagtttattccgatgatggcggactgttcgccgctgttgctggatcttaatgagaacgatccgggtattctggttacgcaatctgtgcataaacaacaggctggtttttctcagacttcacaaattcataaaaaagacagccacatcaaagggcaacagcgttatgtaccgcacaaacgcatgaacaacgcctttatgatgcacgcctccaccagcccgttctatccgctgtttgccgcactgaatatcaacgccaaaatgcatgaaggtgtcagcggtcgtaatatgtggatggattgtgtggtaaatggcattaatgcccgcaaactgatcctcgataactgtcagcatattcgtccgttcgtacctgaactggtggatggtaaaccctggcagtcgtatgaaacagcgcaaattgcggttgatctgcgcttcttccagtttgtaccaggggaacactggcattcttttgaaggctatgcagagaatcaatactttgtcgatccatgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgcttgagtccgacgcgccattagcagaagtgctaccttccatctacaaacagcatgaagagcgctacgccggttataccctgcgtcagttgtgtcaggaaatgcatgatttgtatgcccgccacaacgtgaaacaactgcaaaaagagatgttccgtaaggagcacttcccacgcgtcagcatgaatccgcaagaagccaactacgcctatttacgcggtgaagtggaactggttcgtctgccggatgcagaaggccgtatcgctgccgaaggtgcgcttccttatcctccgggtgtgctgtgtgttgttccgggtgaaatctggggtggtgctgttctgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatga

SEQ ID NO: 291 - protein, 732 aa, Escherichia coli
MSKLKIAVSDSCPDCFTTQRECIYINESRNIDVAAIVLSLNDVTCGKLDEIDATGYGIPVFIATENQERVPAEYLPRISGVFENCESRREFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELIAEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALNINAKMHEGVSGRNMWMDCVVNGINARKLILDNCQHIRPFVPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 292 - DNA, 2148 bp, Escherichia coli
  CDS (1)..(2148)
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaataa

SEQ ID NO: 293 - protein, 715 aa, Escherichia coli
MNVIAILNHMGVYFKEEPIRELHRALERLNFQIVYPNDRDDLLKLIENNARLCGVIFDWDKYNLELCEEISKMNENLPLYAFANTYSTLDVSLNDLRLQISFFEYALGAAEDIANKIKQTTDEYINTILPPLTKALFKYVREGKYTFCTPGHMGGTAFQKSPVGSLFYDFFGPNTMKSDISISVSELGSLLDHSGPHKEAEQYIARVFNADRSYMVTNGTSTANKIVGMYSAPAGSTILIDRNCHKSLTHLMMMSDVTPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLINGSIERAIKFRKEIKRLRTESDGWFFDVWQPDHIDTTECWPLRSDSTWHGFKNIDNEHMYLDPIKVTLLTPGMEKDGTMSDFGIPASIVAKYLDEHGIVVEKTGPYNLLFLFSIGIDKTKALSLLRALTDFKRAFDLNLRVKNMLPSLYREDPEFYENMRIQELAQNIHKLIVHHNLPDLMYRAFEVLPTMVMTPYAAFQKELHGMTEEVYLDEMVGRINANMILPYPPGVPLVMPGEMITEESRPVLEFLQMLCEIGAHYPGFETDIHGAYRQADGRYTVKVLKEESKK

SEQ ID NO: 294 - DNA, 2163 bp, Haemophilus influenzae
  CDS (1)..(2163)
atgccaaatttaaaaattgcatatagtccaaaagttgaacaatatttctctacaaatagagaattagttgagattgctaaaacagactttacagatgttgcagctatcgtattaagttcaagtgatgtaggtgaatacctcgatagaattaaagcaacgaaatttgatgttccagtgtttattgttcaaaccgacgaacaacaggtggatccaaaattctatgattctatttaccatatccaagatttaaacggttatgacatcaaactttatagccgccaaatcgaaactgcagcaaaactttatgaagaaaaaatgttaccgccattcttcaaaatgttaagtgaatatgtggaaatgggtaatatcgctttcgactgtccgggacatcaaggtggtcaatactatcgtaaacatccagctggtcgtttcctttatgacttctacggtgaaaacattttccgttcggacatttgtaatgcggacgtgaaattaggtgacttgttaattcacgaaggggcagcttgtgatgcacaaaaatatgcggctcaagtattcaatgcagataaaacttacttcgtattgaatggtacatcttcttcaaacaaagttgcgttaaatgctgtacttgctcctggcgatttagtgttatttgatcgtaataaccataaatcaaaccaccatggtgcattaattcaagcgggtgctaccccaatttacttagaaactgcacgtaacccatttggtttcattggtggtattgatagtcactgcttcgaagaagattatctgaaatcattaattaaagaagttgcacctgaaaaattaaaccaaaaacgtccattccgtttggcagtgattcaattaggtacttatgacggtacaatttataacgcacgccaagtagtggataaaataggtcacctttgtgattacatcttattcgactctgcatgggtaggttatgaacaattcattccaatgatgaaagactgctcgccattattgcttgaattaaatgaaaatgacccaggtattttagtgacacaatctgttcataaacaacaagcaggtttctcacaaacttcacaaattcacaaaaaagataaacacattaaaggtcaagatcgttatgtaaatcacaaacgtttcaataatgcctttatgttacatgcgtcaactagtccgttctatccgttatttgctacgttagatgtgaatgcgaaaattcaaggtagtgaagctggtcgtcgattatggcatgaatgtgtgaaagtaggtatcgaagcgcgtaaattagtgttaaaccactgtgaattaattcgtccatttattccaaccacaattaaaggtaaaaaatggcaagattatgacacagaggaaatcgcaactaatctcgagttcttcaaattccacccaacagatacatggcataaatttgaaggttatgctgatgaacaatacttcgttgatccatgtaaattcttgcttaccacaccgggtattagcttagaaacaggtgaatatgaagaatttggtgtaccagcaaccattcttgctaactacttacgtgaaaacggtattattccggaaaaatgtgacttgaactcaatcttattcttgctcactccagcagaaaccatcaccaaaatgcaaactttagttgctcaaatcgccttgtttgaaaaacacattaaacaagactctttattaaaatatgtcttaccaactgtgtataaaaacaatgaagatcgttacaaaggttacaccattcgtcaattatgccaagaaatgcatgatctttatgtaagccgaaatgtaaaacaacttcaaaaagatttgttccgcaaagcgacattaccagaatatgtattaaatccacatgatgcaaatattgagttaatacgtaacaaagttgaactcgttccgttgactgatattgttggtcgtgtggctgcggaaggtgcgttaccttaccctccaggtgtgttatgtgtagtgccaggagaaaaatggagcactacagcacaccaatatttccttgcgttagaagaagggatcaacacattacctggtttcgcacctgaaatccaaggggtttacttacaaaaagaccctgatggacgtactcgtgcatatggctatgttttaactgactattaa

SEQ ID NO: 295 - protein, 720 aa, Haemophilus influenzae
MPNLKIAYSPKVEQYFSTNRELVEIAKTDFTDVAAIVLSSSDVGEYLDRIKATKFDVPVFIVQTDEQQVDPKFYDSIYHIQDLNGYDIKLYSRQIETAAKLYEEKMLPPFFKMLSEYVEMGNIAFDCPGHQGGQYYRKHPAGRFLYDFYGENIFRSDICNADVKLGDLLIHEGAACDAQKYAAQVFNADKTYFVLNGTSSSNKVALNAVLAPGDLVLFDRNNHKSNHHGALIQAGATPIYLETARNPFGFIGGIDSHCFEEDYLKSLIKEVAPEKLNQKRPFRLAVIQLGTYDGTIYNARQVVDKIGHLCDYILFDSAWVGYEQFIPMMKDCSPLLLELNENDPGILVTQSVHKQQAGFSQTSQIHKKDKHIKGQDRYVNHKRFNNAFMLHASTSPFYPLFATLDVNAKIQGSEAGRRLWHECVKVGIEARKLVLNHCELIRPFIPTTIKGKKWQDYDTEEIATNLEFFKFHPTDTWHKFEGYADEQYFVDPCKFLLTTPGISLETGEYEEFGVPATILANYLRENGIIPEKCDLNSILFLLTPAETITKMQTLVAQIALFEKHIKQDSLLKYVLPTVYKNNEDRYKGYTIRQLCQEMHDLYVSRNVKQLQKDLFRKATLPEYVLNPHDANIELIRNKVELVPLTDIVGRVAAEGALPYPPGVLCVVPGEKWSTTAHQYFLALEEGINTLPGFAPEIQGVYLQKDPDGRTRAYGYVLTDY

SEQ ID NO: 296 - DNA, 2196 bp, Sinorhizobium meliloti
  CDS (1)..(2196)
atgcgcagcctcgcagaggcgattgaaaaggaaggttatcgggtcgttgcagggctcacctatgaggatgcacgccgcctcgtgaacgtcttcaacaccgagtcctgctggctgatttcagtcgacgggacggaatcaagtacgacgcgctgggagattttagccgagctgctcgccgcgaaacgctcccggaacaacctgctgccaatctttctgtttggcgacgatacaacggcggaaatggtgccggcgcccgtgctgcgccacgccaatgcctttatgcgtcttttcgaggattctccggaattcatggcgcgcgcgatcgtgcgcgcggcgcagaattatcttgagaggcttccgcctccaatgttcaaggcgttgatggaatacacgcttcacggcgcctattcctggcacacgccagggcacggaggcggggtggcgtttcgcaagagcccggttggccagctcttttatacgttttttggagagaacacattgaggtcggacatttctgtgtccgtcggcagcgttggttcgctcctcgatcatgttgggccgattggcgagggtgagcgcaatgccgctcgcatatttggtgcggatgagacgctgttcgttgtcggcggcacctcgaccgccaataagatcgtgtggcagggtatggtcactcggaacgacctcgtcctctgcgaccgaaactgccataagtctatcctgcactcgctgattatgacgggtgcaacgccgatttacctgacgccctcacgcaacggcctcggcatcatcggaccgattgcgaaggagcagtttaccccagaggcaatcgcgcacaagatcgtcgccagtccgtttgccagtgagacgaacggtaaagtgcgcctgatggtagtgacaaactccacctatgatgggctctgctacaatgtagatggaatcaaatcggcgctcggcgatgcggtggaggtactgcatttcgacgaggcctggtttgcttacgccaattttcacgaattctacgatggttatcacgcgatctcttcaacgaagcccgcgcgctcgcaagaagccatcacattcgcaacccagtccacgcacaagctgctggccgccttctctcaagcttcaatgcttcatgtgcagcatgccgtggcgaagcaactcgacatcacacgcttcaacgaagcgttcatgatgcacacatcgacatcgccgcaatatgggatcatcgcctcgtgcgacgtggctgctgccatgatggagcagcccgccgggcgggcgctggtacaggagaccattgacgaagccatgagtttccgccgagccgtcaacgccgtgcggacacagatgcaggattcctggtggttcgaagtctgggagccccccatcgcggatcgggccccgagcgacgccacgtcggattggcttctaaagcccggtgacgcttggcatggtttcgaagacctggctgagaatcacgttatggttgacccgatcaaggtcacgatcctttcgcccggactcaatgcgggcggagcgatgctggagcatggtattccggctgcagtcgtcacgaagttcctttcttctcgccggatcgaaatcgagaaaaccggcctctactctttcctggtgctcttctccatggggatcacacggggcaagtggagcaccctgatcaccgagctcttgaacttcaaagacctctatgatgccaatgcgcctctttcacgcgcccttcccgccctcgcggcagcccatccggacgtctaccgtgcaatgggccttagagatctttgcgagaaaattcacgacgtgtaccgcagcgatggcgtgccgaatgcccagcgcgagatgtacaccgtgctacccgaaatggcactgcgcccggcagacgcctacaaccgcctggtcaaggggtgcgtcgaaagcgtcgatatcgacgaattgatcggccggacactcgcagtcatgattgtaccctatcctccgggcatcccgctcatcatgcctggcgagcggatcactgcagccacaagatcgatccaggactatctcgtctacgcccggagtttcgacaggaaattcccgggatttgagacggacatccacggactccgtttcgtcgctaacccgagtggacggagatatctcgtggattgcatcgtcgaggagggacaagatgataccgcgtaa

SEQ ID NO: 297 - protein, 731 aa, Sinorhizobium meliloti
MRSLAEAIEKEGYRVVAGLTYEDARRLVNVFNTESCWLISVDGTESSTTRWEILAELLAAKRSRNNLLPIFLFGDDTTAEMVPAPVLRHANAFMRLFEDSPEFMARAIVRAAQNYLERLPPPMFKALMEYTLHGAYSWHTPGHGGGVAFRKSPVGQLFYTFFGENTLRSDISVSVGSVGSLLDHVGPIGEGERNAARIFGADETLFVVGGTSTANKIVWQGMVTRNDLVLCDRNCHKSILHSLIMTGATPIYLTPSRNGLGIIGPIAKEQFTPEAIAHKIVASPFASETNGKVRLMVVTNSTYDGLCYNVDGIKSALGDAVEVLHFDEAWFAYANFHEFYDGYHAISSTKPARSQEAITFATQSTHKLLAAFSQASMLHVQHAVAKQLDITRFNEAFMMHTSTSPQYGIIASCDVAAAMMEQPAGRALVQETIDEAMSFRRAVNAVRTQMQDSWWFEVWEPPIADRAPSDATSDWLLKPGDAWHGFEDLAENHVMVDPIKVTILSPGLNAGGAMLEHGIPAAVVTKFLSSRRIEIEKTGLYSFLVLFSMGITRGKWSTLITELLNFKDLYDANAPLSRALPALAAAHPDVYRAMGLRDLCEKIHDVYRSDGVPNAQREMYTVLPEMALRPADAYNRLVKGCVESVDIDELIGRTLAVMIVPYPPGIPLIMPGERITAATRSIQDYLVYARSFDRKFPGFETDIHGLRFVANPSGRRYLVDCIVEEGQDDTA

SEQ ID NO: 298 - DNA, 2196 bp, Escherichia coli
  CDS (1)..(2196)
atggggcagggttttacaccttgtccagtattcttacttccccgaaacgggtttgcgcttatgaaatcaatgaatattgccgccagtagtgaactggtatcccgactttctactcatcgccgcgtggtggcgttgggagatactgattttacggacgtcgcggcagtcgtcattaccgctgcggatagtcgcagtggcattcttacgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttctttaaaaagcatcctgccggacgccatttttacgatttctttggtgagaacatctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctctttgaccgtaacaaccataagtcgaatcatcacggcgcgttgattcaggcgggggcgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacatcagtgttagccagcgaccgtcgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaattccattctgttcttattaactccggcggaaagccacgagaagctggcacaactggtggcgatgctggctcaatttgaacagcatattgaggatgactcgccgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcatgaaacggttgtacggttatgtgttgaagtaa

SEQ ID NO: 299 - protein, 731 aa, Escherichia coli
MGQGFTPCPVFLLPRNGFALMKSMNIAASSELVSRLSTHRRVVALGDTDFTDVAAVVITAADSRSGILTLLKRTGFHLPVFLYSEHAVELPAGVTAVINGNEQQWLELESAACQYEENLLPPFYDTLTQYVEMGNSTFACPGHQHGAFFKKHPAGRHFYDFFGENIFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPFRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLAEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGMKRLYGYVLK

SEQ ID NO: 300 - DNA, 2199 bp, Escherichia coli
  CDS (1)..(2199)
atgtcagaattaaaaattgccgttagtcgttcttgcccggattgtttttccactcatcgtgcatgcgtgaatatagacgaaagtaattatattgacgttgccgccattattttatcagtcagtgatgttgaacgtggaaaactcgatgaaatagacgctactggctatgacattcctgtttttattgcaacggaaaatgaagaacgtataccagcagaatatctttcacgtatttctggtgtcttcgaacatggagaagcacgcaaagaattttatggtcgtcagttagaaaccgctgccagccattatgaaactcaactgcgcccacctttctttcgcgcactggtcgattatgtcaatcagggcaacagcgcatttgactgccccggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcagcaaaagtgtttaatgccgataaaacctacttcgttttaaatggcacttcatcttctaacaaagtggttttaaacgccctgctgacaccgggtgatctggtgctatttgaccgcaataaccataagtctaaccaccacggggccttgctacaggctggtgcaacaccggtttatctggaaacagcacgtaacccgtatggttttatcggtggtattgatgcacactgcttcgaagaaagttatctgcgtgaactgattacagaagttgcaccgcaacgggcaaaagaggcgcgtccgttccgcctcgctgtgattcagctaggcacctacgacggtacgatttataacgcccgccaggtggtggataaaattggtcatctgtgtgactacatcctgtttgattccgcatgggtcggctatgaacagtttattccgatgatggctgactgttcgccgctgttgctggatcttaatgagaacgatccgggtattctggttacgcaatccgtacataaacagcaggctggtttttctcaaacttcacaaatccataaaaaagacagccacatcaaagggcaacagcgttatgtaccgcacaaacgcatgaacaacgcctttatgatgcatgcctccaccagcccgttctatccgctgtttgccgcactggatatcaacgccaaaatgcatgaaggtgtcagcggtcgtaatatgtggatggattgtgtggtaaatggcattaatgcccgcaaactgatcctcgataactgtcagcatattcgtccgttcatacctgaactggtggatggtaaaccctggcagtcgtatgaaacagcgcaaattgcggttgatctgcgcttcttccagtttgtaccaggtgagcactggcattcttttgaaggctatgcagagaatcaatactttgttgatccgtgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgctggaatctgatgcgccgctggcggaagtgctaccttccatctacaaacagcatgaagagcgctacgccggttatacccttcgtcagttgtgccaggaaatgcatgatttgtatgcccgccacaacgtgaaacaactgcaaaaagagatgttccgtaaggaacacttcccacgcgtcagcatgaatccgcaagaagctaactacgcctatttacgcggtgaagtggagctggttcgtctgccggatgcagaaggccgtatcgctgccgaaggtgcgcttccttatcctccgggtgtgctgtgtgttgttccgggtgaaatctggggtggtgctgttttgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgctgaaaggggaaaaattataa

SEQ ID NO: 301 - protein, 732 aa, Escherichia coli
MSELKIAVSRSCPDCFSTHRACVNIDESNYIDVAAIILSVSDVERGKLDEIDATGYDIPVFIATENEERIPAEYLSRISGVFEHGEARKEFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELITEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALDINAKMHEGVSGRNMWMDCVVNGINARKLILDNCQHIRPFIPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 302 - DNA, 2307 bp, Yersinia pestis
  CDS (1)..(2307)
atgattgatttaagcagtcacaagaaacgcaacgttttagtggttgacagcaatattcgtgatatcaataccgctaatggtcgggcggtaaacgaacttatcattgcgcttaatgacattaattttaatgtgattgcggcggcgacgtttgaagatggcgcggcaacagtgatctccgactcttcgttgtgctgtatttttgtcgattggacttcgggtggtaatgatgatgaatcccatagtcaggcatttgcattgctacaagacattcgtcgccgtaataaatcagtgcctgtgttattgatggctgagcattcatgtatcaatagcttaagtttggagaccatgcagcttgttaatgaatttgtttggatgcatgaagatacctccgagtttatcgctgctcgtgccaaagcactcatcatcaagtattaccagcagttgctgccgccttttacgcaagcgctgtttcaatatacgcaagataatcctgaatattcatgggctgcccccggtcatcaagggggcgttgccttcagtaagacggcggttggacgcgagtttcttgatttctttggcgagaatctatttcgtacggatactggtattgaacgtgagtcattgggatctttactggatcacagtgggccgataaaagagtcagaagcgtatgccgcacaagtttttggtgcacatgcaagttactcgatgcttaatggcacatcgggctctaatcgcgccattatggccgctgtcgtgggagataagcagatcgcattgtgtgatcgtaactgtcataaatccattgagcagggattggtcctgtcgggtgcattaccggtattttttattccaacccgtaaccgctatggcattattggaccaattcctaaagcacaattccaacccacggctattgcacaaaaaattgaacaaaaccccttaaagtcattggcttgtgatagcaagcccgtctatgcagttatcacgaattgtacctatgacggtatgtgctataacgcccaacaggcacaggatttattggcaaaaagcgttgatcagattcatttcgacgaagcttggtacgcctatgcccgttttaatcccctttatcgggagcgttttgcgatgcgtggtgacccggctgaccatgatgcgctgggaccaactatttttgctacacaatcaacgcataaattattggcagcgctgtcgcaagcttcttatattcatgtgagaaatggcaaaaagccgatagaacattcgcggtttaatgagtcgtatatgttgcagtcaaccacttcgccattgtacgccattattgctgccaatgaagtgggggcggcgatgatggaaggcgggcaggggctagcattgacacaagaggtgatcgatgaagctgttgattttcggttggcgctggctcgtgcacatgatgcttttgcaaaacaaggcgaatggttctttaaaccttggaatacaccggaaataacggatagcaaaagcggtaaaaagttacctttctcccaagcatcacgagagcaactgacaaccgatcccgcctgttgggttctcaagccgggagacccgtggcatggtttcgagcagttggaagaagattggtgcatgttggatccgatcaaggccgggattatggtgccgggaatgggggatgacggtaagttgtcagaaaagggaattcccgcagcgatagtgaccgccttccttgggcagcggggaattgtaccgtcgcggaccacggattttatggtgctgtgcttgttttcggtgggtgtaacgaaaggtaaatggggcacactcattaatgtgttactggaatttaagcagcactacgatagcaatacaccgatatcggtgtgcctacctgacttggcgaaaaattatcctcatcaatacgctcataaggggttaaaagtgttgtgtgatgagatgtttgcttatatgaagatcagtgaaatggataaactgcaagctgaggcatttagccatttgcctacgccagtggtcttaccccgtcaggcttttcaagatcatatggctgggcggtgtgagctactacctatcgataagcttgctgggcgtgtttccgctgtcggggttattccatatccgccgggcatcccaattgtcatgccgggggagagttttggtagccatgaagaaccatggctacgttatatcttaagtatcaccaaatggggccagcattttcccggcttcgagaagatcttggaagggtccgagcagaagaatgggcaatattttatttgggtactaaagcagtaa

SEQ ID NO: 303 - protein, 768 aa, Yersinia pestis
MIDLSSHKKRNVLVVDSNIRDINTANGRAVNELIIALNDINFNVIAAATFEDGAATVISDSSLCCIFVDWTSGGNDDESHSQAFALLQDIRRRNKSVPVLLMAEHSCINSLSLETMQLVNEFVWMHEDTSEFIAARAKALIIKYYQQLLPPFTQALFQYTQDNPEYSWAAPGHQGGVAFSKTAVGREFLDFFGENLFRTDTGIERESLGSLLDHSGPIKESEAYAAQVFGAHASYSMLNGTSGSNRAIMAAVVGDKQIALCDRNCHKSIEQGLVLSGALPVFFIPTRNRYGIIGPIPKAQFQPTAIAQKIEQNPLKSLACDSKPVYAVITNCTYDGMCYNAQQAQDLLAKSVDQIHFDEAWYAYARFNPLYRERFAMRGDPADHDALGPTIFATQSTHKLLAALSQASYIHVRNGKKPIEHSRFNESYMLQSTTSPLYAIIAANEVGAAMMEGGQGLALTQEVIDEAVDFRLALARAHDAFAKQGEWFFKPWNTPEITDSKSGKKLPFSQASREQLTTDPACWVLKPGDPWHGFEQLEEDWCMLDPIKAGIMVPGMGDDGKLSEKGIPAAIVTAFLGQRGIVPSRTTDFMVLCLFSVGVTKGKWGTLINVLLEFKQHYDSNTPISVCLPDLAKNYPHQYAHKGLKVLCDEMFAYMKISEMDKLQAEAFSHLPTPVVLPRQAFQDHMAGRCELLPIDKLAGRVSAVGVIPYPPGIPIVMPGESFGSHEEPWLRYILSITKWGQHFPGFEKILEGSEQKNGQYFIWVLKQ

SEQ ID NO: 304 - DNA, 2145 bp, Salmonella enterica subsp. enterica serovar Typhi
  CDS (1)..(2145)
atgaacgttattgctatcatgaaccacatgggcgtctactttaaagaagagcctattcgtgaactgcatcgtgcactggaaggtttaaatttccgtatcgtctatccaaacgaccgagaagacctgctgaagctgattgaaaataactcccgcctttgcggcgtcattttcgactgggataaatataaccttgagctttgcgaagagattagcaagctgaacgagtatatgccgctgtatgccttcgccaacagctactctacgctggacgtcagcctcaacgatctgagaatgcaggttcgcttctttgaatatgctttaggcgccgcagccgatatcgcggcgaaaattcgccagaataccgatgaatacatcgacaatattctgccgccgctgacaaaagcactgttcaaatatgtgcgcgaagggaaatacactttctgtacgcctggccacatgggcggtactgctttccagaaaagccccgtcggcagcatcttttatgatttcttcggcccgaacacgatgaaatccgatatttcgatttccgtttccgaactgggttcgctgctggaccactccggcccgcataaagaagcggaagagtatatcgcccgcgtctttaacgccgaacgtagctacatggtgacgaacggcacctctacggcgaacaaaatcgtcggtatgtactccgcgccggcaggcagcacggtactgattgaccgtaactgccataaatcgctgacccatctgatgatgatgagcgacattacgccgatttatttccgcccaacccgtaacgcctacggtattcttggcggtattccgcaaagcgagttccagcacgccactatcgctaaacgggtaaaagagacgcctaacgccacctggccggtccatgctgttattactaactcaacctatgacggtctgttgtataacactgactacatcaagaaaactctggatgtgaagtccattcattttgactccgcctgggtgccttacaccaatttctcccctatttatcagggtaaatgcggtatgagcggcgaccgtgtagaaggcaaaatcatttatgaaacccagtccacgcataaactgctggcggcgttttcacaggcatccatgattcatgttaaaggcgacattaacgaagaaacctttaacgaagcctacatgatgcataccaccacttctccgcactacggtatcgtagcgtctactgaaaccgcagcggcgatgatgaaaggtaatgcgggtaaacgcctgattaacggctctattgaacgtgcgattaaattccgtaaagaaattaaacgcctgaaaagcgaatctgacggctggttctttgacgtatggcagccggaacatatcgatggagctgagtgctggccgctgcgttcagatagcgcatggcatggcttcaaaaatatcgataacgaacacatgtacctcgacccgatcaaagtcactatcctgacgccggggatgaagaaagacggtacgatggatgaattcggtattccggcaagtctggtcgccaaatatctcgatgaacgcggcatcatcgtagaaaaaaccggtccatacaacctgctgttcctgttcagcattggtatcgacaaaaccaaagctctgagcctgctgcgcgcgctcactgaatttaaacgcgcctttgacctgaacctgcgcgtcaaaaacattctgccggcactgtatcgcgaagcgcctgagttttatgaaaatatgcgcatccaggaactggcgcagaatattcataaactggtcgaacatcataatctgccggacttaatgtaccgtgcgtttgaagtgctgccgaaaatggtgatgacgccgtatactgcgttccagaaagagctgcatggcgaaacggaagaggtgtatcttgaagagatggttggacgcgtcaacgccaacatgatccttccttaccctccgggagtgccgctggtgatgcctggtgaaatgatcaccgaggaaagccgtccggtactggaattcctgcaaatgctgtgcgaaatcggcgctcactatccgggcttcgaaaccgatatccacggcgcctatcgtcaggctgacggacgttacaccgttaaggtgctgaaagaaaatacgaaataa

SEQ ID NO: 305 - protein, 714 aa, Salmonella enterica subsp. enterica serovar Typhi
MNVIAIMNHMGVYFKEEPIRELHRALEGLNFRIVYPNDREDLLKLIENNSRLCGVIFDWDKYNLELCEEISKLNEYMPLYAFANSYSTLDVSLNDLRMQVRFFEYALGAAADIAAKIRQNTDEYIDNILPPLTKALFKYVREGKYTFCTPGHMGGTAFQKSPVGSIFYDFFGPNTMKSDISISVSELGSLLDHSGPHKEAEEYIARVFNAERSYMVTNGTSTANKIVGMYSAPAGSTVLIDRNCHKSLTHLMMMSDITPIYFRPTRNAYGILGGIPQSEFQHATIAKRVKETPNATWPVHAVITNSTYDGLLYNTDYIKKTLDVKSIHFDSAWVPYTNFSPIYQGKCGMSGDRVEGKIIYETQSTHKLLAAFSQASMIHVKGDINEETFNEAYMMHTTTSPHYGIVASTETAAAMMKGNAGKRLINGSIERAIKFRKEIKRLKSESDGWFFDVWQPEHIDGAECWPLRSDSAWHGFKNIDNEHMYLDPIKVTILTPGMKKDGTMDEFGIPASLVAKYLDERGIIVEKTGPYNLLFLFSIGIDKTKALSLLRALTEFKRAFDLNLRVKNILPALYREAPEFYENMRIQELAQNIHKLVEHHNLPDLMYRAFEVLPKMVMTPYTAFQKELHGETEEVYLEEMVGRVNANMILPYPPGVPLVMPGEMITEESRPVLEFLQMLCEIGAHYPGFETDIHGAYRQADGRYTVKVLKENTK

SEQ ID NO: 306 - DNA, 2163 bp, Yersinia pestis
  CDS (1)..(2163)
atgacactattaaaaatagcaacaagcgcccgcctggcttcttatgtagaaactcagcgcggagtggtgtacctcaatcagactgactttactgatgttgccgcggtggtaatgtcggttgaagatgcaaatgcgggtatattgtcaatgctgcatgaccttggttttgctattcctgcgtttattgccgtgacggcagaacagacggtctctgctgattatttgcccttgattaaaggtgtcattacgcttggtgaagcaaataaagctttttataacgctcaggtagaagctgccgccagtgaatatcaaaagaatctcttaccgccttttttctcaacactgaaaaaatatgtcgagatgaataactcgacctttgcttgccctggccatcaggggggcgaattttttcgcaagcatcctgcaggacgccagttttttgaattctacggtgagacgatttttcgttcagatatgtgtaatgccgatgtcaaattaggtgatttacttatccatgaaggggcggcaaaagatgcacagaaatatgctgctaaggtattcaatgccgataaaacctattttgtcctgaacggtacctcggcggccaacaaggtcgtgaccaacgctttactgacccgtggtgatttagtgttgtttgaccgcaataaccataaatctaaccatcatggtgcgctgatccaggcgggcgcgacgccggtttatctggaaacggcccgtaacccctttggttttattggtggtattgatgcgcactgcttcaatgaagattatttacgtcaacaactgcgtgaagttgctcccgagcgtgcagaagaggctcggccattccgattagcgatcattcaattgggtacctacgacggtacggtatataacgcccgccaagtagttgatagtattggtcatttatgcgattacattttgtttgattctgcttgggtgggttacgaacaatttattccgatgatgaaggatttctcaccgttattactggaattaaatgaaaatgaccctgggattattgtgactcaatcggtacacaagcagcaggccggtttttctcagacctctcaggtacataaaaaagataatcacattaaaggacagaaacgtcactgtaaccataagcgttttaataatgcctttatgttgcatgcatcgaccagtccgttttatccattatttgcggcattggatgttaatgccaaaatacactctggtgacagtggccgccgtatgtggatggattgtgtaaaactcggtattgaaacccgtaaatcgttattggcacgctgttcgatgttacggccttttattcctccagttgttggcggtaaaaattggcaagattatgctactgatgtgattgccaatgatgcgcgcttctttaattttgtcccagatgaacgctggcatggatttgagggatataaccaagatcagtatttggttgatccgtgcaaattattgctgacgacgccgggaattgatgccagtactggccgatatacttcgtttggtattccggcggctattttggcgactttcctgcgtgaaaatggaattgtgccagaaaaatgtgatcttaactcgatcctattcctgctgaccccggcagaaaataccgccaaaatggcacacctggtggatatgttggtgcagtttgaacgctatgttgaacaagatgcgaagctgtgtgatgtattaccgacgatctatcgtaagaatgaagagcgttatcacggttataccttgcgtcagttatgccaagaaatgcatgacctgtacgtcagccatgacgttaagcaattgcaaaaggatatgttccgtaaagccagtttcccgcaggtagtcatgaacccgcaagacgccaatattcagtttatccgcgataatattgagttgattcctattgctgaagctgaaggccgtattgccgccgaaggcgctttgccttatccaccgggtgtgctgtgtgtggtgcccggtgaagtgtggggtggggcggttcagcgttattttctggcgctggaagaggggattaacttactgccgggcttttcacctgagttacagggcgtttatatcgaaaaaggtgatgtgtcttggcggcgtatctttggttatgtgattacgcaataa

SEQ ID NO: 307 - protein, 720 aa, Yersinia pestis
MTLLKIATSARLASYVETQRGVVYLNQTDFTDVAAVVMSVEDANAGILSMLHDLGFAIPAFIAVTAEQTVSADYLPLIKGVITLGEANKAFYNAQVEAAASEYQKNLLPPFFSTLKKYVEMNNSTFACPGHQGGEFFRKHPAGRQFFEFYGETIFRSDMCNADVKLGDLLIHEGAAKDAQKYAAKVFNADKTYFVLNGTSAANKVVTNALLTRGDLVLFDRNNHKSNHHGALIQAGATPVYLETARNPFGFIGGIDAHCFNEDYLRQQLREVAPERAEEARPFRLAIIQLGTYDGTVYNARQVVDSIGHLCDYILFDSAWVGYEQFIPMMKDFSPLLLELNENDPGIIVTQSVHKQQAGFSQTSQVHKKDNHIKGQKRHCNHKRFNNAFMLHASTSPFYPLFAALDVNAKIHSGDSGRRMWMDCVKLGIETRKSLLARCSMLRPFIPPVVGGKNWQDYATDVIANDARFFNFVPDERWHGFEGYNQDQYLVDPCKLLLTTPGIDASTGRYTSFGIPAAILATFLRENGIVPEKCDLNSILFLLTPAENTAKMAHLVDMLVQFERYVEQDAKLCDVLPTIYRKNEERYHGYTLRQLCQEMHDLYVSHDVKQLQKDMFRKASFPQVVMNPQDANIQFIRDNIELIPIAEAEGRIAAEGALPYPPGVLCVVPGEVWGGAVQRYFLALEEGINLLPGFSPELQGVYIEKGDVSWRRIFGYVITQ

SEQ ID NO: 308 - DNA, 2271 bp, Salmonella enterica subsp. enterica serovar Typhi
  CDS (1)..(2271)
atgatgaaagtattaattgttgaaagtgagtttctgcatcaggacacctgggttggcaacgcggttgagcgtctggcggatgccttgagccaacaaaatgttaccgtcattaaatcgacatccttcgatgacggctatgccatcttgtccgcgaacgaagccattgactgtctgatgtttagctaccaaatggaacaaccggatgagcacctgagcgtcaggcaattgatcggtaagcttcacgagcgtcagcaaaacgtgcccgttttcctgttaggcgacagggaaaaagcgacggcatcgctggaccgcgacctgctggagcttgtcgatgaattcgcctggattctggaagacaccgctgactttatcgccggacgcgccgttgccgccatgacccggtatcgccagcaactgttaccgccgctgtttaacgcgttgatgaaatacagcgacattcatgaatattcatgggcggcgccgggacaccagggcggcgtcggtttcactaaaacgcctgccggtcgcttttatcacgattattatggcgaaaacctgttccgcagcgatatggggattgagcgtaccacgctcggttcactcctcgaccataccggcgcgtttggcgaaagcgagaaaaacgccgcccgcgtattcggtgctgaccgctcctggtccgtggttgtcgggacctcaggttctaaccgtactattatgcaggcctgtatgacggataatgatgtcgttgtactggatcgtaactgccataaatccatcgaacaggggctgatcctcactggggccaaaccggtatatatggtgccaagccgtaaccgttacggcattatcgggccaatctacccgcaggaaatgcagcctgaaaccttgcagaaaaaaatcagcgccagcccgctgaccaaaaccaaagccggacagaaaccgtcttacagcgtggtgaccaactgtacctatgacggcgtatgctataacgccaaagaggcgcaggatctgctggcaaaaaccagcgatcgcattcacttcgacgaagcatggtacggctatgcgcgcttcaacccgatttattgcgatcactacgcgatgcgcggcgagccaggcgaccataacggtccgaccgtgtttgccacccactccacgcacaaattactgaacgcgctttcacaagcttcctacattcacgtccgtgaaggccgtggcgcggtgaatttctcccgcttcaaccaggcctatatgatgcatgccaccacctctccgttatatgccatctgcgcatccaacgatgtggcggtatcgatgatggacggtaacagcggcctgtccctgactcaagaggtgattgacgaagcggttgatttccgtcaggcgatggcgcgtctttataaagagtttaccgatgaaggcgactggttctttaaaccgtggaataaagacgtcgtcaccgatccacaaaccggtaaaacgtatgacttcgccgacgcgccggcaaaactgctggcaaccgaccagaactgctgggtcatgcgccccggggaaacctggcacggctttaaagacctgccggataactggagtatgctggacccgattaaagtcagtatcctggcgccgggtatgggcgacgatggcgaactggaagcatccggcgtacctgctgcgctggtcacagcatggcttggccgccacggtatcgtgccgacccgcaccaccgacttccagattatgttcctgttctccatgggggtaactcgcgggaaatggggaacgctgatcaacacgctgtgctccttcaaacatcattacgacgcgaatacgccgctggcgcaggtgatgccggaactggtgcaggattatcctgacacttacgcgaacatgggtattcatgacctgggcgataaaatgtttgcctggctacgtgaaaataacccgggcgcccgtctcaatgccgcctattccaccctgccggttgcggagattaccccgcgcgacgcctacaacgcgatcgtgaacaacaatattgaaatggtggcgattgaaaatctaccgggtcgcattgcggcgaactccgttattccttacccgccaggcatcccgatgctgctctccggtgaaaactttggcgatgaaaacagtccgcaggtgggttacttacgctcactgcaatcctgggatcatcacttccctggctttgagcatgaaaccgaaggcacggaaattattgatggcgtatatcacgttatgtgcgtgaaagcctaa

SEQ ID NO: 309 - protein, 756 aa, Salmonella enterica subsp. enterica serovar Typhi
MMKVLIVESEFLHQDTWVGNAVERLADALSQQNVTVIKSTSFDDGYAILSANEAIDCLMFSYQMEQPDEHLSVRQLIGKLHERQQNVPVFLLGDREKATASLDRDLLELVDEFAWILEDTADFIAGRAVAAMTRYRQQLLPPLFNALMKYSDIHEYSWAAPGHQGGVGFTKTPAGRFYHDYYGENLFRSDMGIERTTLGSLLDHTGAFGESEKNAARVFGADRSWSVVVGTSGSNRTIMQACMTDNDVVVLDRNCHKSIEQGLILTGAKPVYMVPSRNRYGIIGPIYPQEMQPETLQKKISASPLTKTKAGQKPSYSVVTNCTYDGVCYNAKEAQDLLAKTSDRIHFDEAWYGYARFNPIYCDHYAMRGEPGDHNGPTVFATHSTHKLLNALSQASYIHVREGRGAVNFSRFNQAYMMHATTSPLYAICASNDVAVSMMDGNSGLSLTQEVIDEAVDFRQAMARLYKEFTDEGDWFFKPWNKDVVTDPQTGKTYDFADAPAKLLATDQNCWVMRPGETWHGFKDLPDNWSMLDPIKVSILAPGMGDDGELEASGVPAALVTAWLGRHGIVPTRTTDFQIMFLFSMGVTRGKWGTLINTLCSFKHHYDANTPLAQVMPELVQDYPDTYANMGIHDLGDKMFAWLRENNPGARLNAAYSTLPVAEITPRDAYNAIVNNNIEMVAIENLPGRIAANSVIPYPPGIPMLLSGENFGDENSPQVGYLRSLQSWDHHFPGFEHETEGTEIIDGVYHVMCVKA

SEQ ID NO: 310 - DNA, 2256 bp, Pseudomonas aeruginosa
  CDS (1)..(2256)
atgtataaagacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactgatccgcgtggcccgcgtgcgggcgccgcaattgccgatcttcgccctcggcgagcaggtgaccatcgagaacgcgccggccgagtccatggccgacctgcaccagttgcgcggcatcctctacctgttcgaagacaccgtgccgttcctcgcccgccaggtcgcccgggcggcgcgcaactacctggccgggctgctgccgccattcttccgtgcgctggtcgagcacaccgcgcagtccaactattcctggcatacgccgggccacggcggcggtgtcgcctatcgcaagagtccggtgggacaggcgttccaccagttcttcggggagaacacgctgcgttccgacctgtcggtctcggtccccgagctgggatcgctgctcgaccataccggccccctggccgaggccgaggaccgtgccgcgcgcaatttcggcgccgaccataccttcttcgtgatcaatggcacttccaccgcgaacaagatcgtctggcactccatggtcggtcgcgaagacctggtgctggtggaccgcaactgccacaagtcgatcctccactcgatcatcatgaccggggcgataccgctctacctgactccggaacgcaacgaactggggatcatcgggccgatcccgctgagcgaattcagcaagcagtcgatcgccgcgaagatcgccgccagcccgctggcgcgcggccgcgagccgaaggtgaagctggcggtggtgactaactccacctacgacggcctgtgctacaacgccgagctgatcaagcagaccctcggcgacagcgtcgaggtgttgcacttcgacgaggcttggtacgcctatgccgcgttccacgagttctacgacggacgctatggcatgggcacctcgcgcagcgaggagggacccctggtgttcgccacccactccacgcacaagatgctcgccgccttcagccaggcctcgatgatccacgtgcaggatggcgggacccggaagctggacgtggcgcgcttcaacgaagccttcatgatgcacatctcgacctcgccgcagtacggcatcatcgcttcgctggacgtggcttcggcgatgatggaagggcccgccgggcgttcgctgatccaggagaccttcgacgaggccctcagcttccgccgggccctggccaacgtacggcagaacctggaccggaacgactggtggttcggcgtctggcagccggagcaggtggagggcaccgaccaggtcggcacccatgactgggtgctggagccgagcgccgactggcacggcttcggcgatatcgccgaagactacgtgctgctcgacccgatcaaggtcaccctgaccaccccgggcctgagcgctggcggcaagctcagcgagcaggggattccggccgccatcgtcagccgcttcctctgggagcgcgggctggtggtggagaaaaccggtctctactccttcctggtgctgttctcgatgggcatcaccaagggcaagtggagcaccctggtcaccgaactgctcgaattcaagcgctgttacgacgccaacctgccgctgcttgacgtcttgccctccgtggcccaggccggcggcaagcgctacaacggagtgggcctgcgcgacctcagcgacgccatgcacgccagctaccgcgacaacgccacggcgaaggccatgaagcgcatgtacacggtgctgccggaggtcgcgatgcggccgtccgaggcctacgacaagctggtgcgcggcgaggtcgaggcggtaccgatcgctcggttggaagggcgcatcgcggccgtcatgctggtaccctatccgccgggtatcccgctgatcatgccgggtgagcgcttcaccgaggcgacccgctcgatcctcgactatctcgagttcgcgcggaccttcgagcgcgccttccctggtttcgactccgatgtgcatggcctgcagcatcaggacggaccgtccgggcgctgctataccgttgaatgcataaaggaataa

SEQ ID NO: 311 - protein, 751 aa, Pseudomonas aeruginosa
MYKDLKFPVLIVHRDIKADTVAGERVRGIAHELEQDGFSILSTASSAEGRIVASTHHGLACILVAAEGAGENQRLLQDVVELIRVARVRAPQLPIFALGEQVTIENAPAESMADLHQLRGILYLFEDTVPFLARQVARAARNYLAGLLPPFFRALVEHTAQSNYSWHTPGHGGGVAYRKSPVGQAFHQFFGENTLRSDLSVSVPELGSLLDHTGPLAEAEDRAARNFGADHTFFVINGTSTANKIVWHSMVGREDLVLVDRNCHKSILHSIIMTGAIPLYLTPERNELGIIGPIPLSEFSKQSIAAKIAASPLARGREPKVKLAVVTNSTYDGLCYNAELIKQTLGDSVEVLHFDEAWYAYAAFHEFYDGRYGMGTSRSEEGPLVFATHSTHKMLAAFSQASMIHVQDGGTRKLDVARFNEAFMMHISTSPQYGIIASLDVASAMMEGPAGRSLIQETFDEALSFRRALANVRQNLDRNDWWFGVWQPEQVEGTDQVGTHDWVLEPSADWHGFGDIAEDYVLLDPIKVTLTTPGLSAGGKLSEQGIPAAIVSRFLWERGLVVEKTGLYSFLVLFSMGITKGKWSTLVTELLEFKRCYDANLPLLDVLPSVAQAGGKRYNGVGLRDLSDAMHASYRDNATAKAMKRMYTVLPEVAMRPSEAYDKLVRGEVEAVPIARLEGRIAAVMLVPYPPGIPLIMPGERFTEATRSILDYLEFARTFERAFPGFDSDVHGLQHQDGPSGRCYTVECIKE

SEQ ID NO: 312 - DNA, 2202 bp, Vibrio cholerae
  CDS (1)..(2202)
atggcgctcgtcttactcactgtgcagtgcacagagagcgccttttttcgccttggagatgtccaaatgaatattttcgctatcttgaaccacatgggtgtgttctttaaagaagagcctgttcgccaactgcatgcagcattagaaaaagccggttacgacgtggtttatccggtggatgacaaagatctgatcaagatgattgagatgaacccacgcatttgcggcgtgctgttcgactgggataaatactcgctagagctgtgtgagcgcatcagtaaagtcaatgaaaaactgcctgtgcacgcctttgctaacgagcaatcgacgttagatatttcgctaaccgatctgcgcctcaacgtgcatttcttcgaatacgctctgggcatggccgacgatatcgccatcaagatcaatcaagcgactcaagagtacaaagacgcgatcatgcctccgtttactaaggcgctgttcaaatatgtagaagagggtaaatacaccttctgtactccgggccatatgggcggtactgcgttccagaaaagccctgttggcagcattttctacgatttctacggtccaaataccttcaaagcggacgtatcgatttcgatgccagaactgggctcactgctcgatcactccggtccacacaaagaagcggaagagtacatcgcgcgcacgttcaatgccgatgcttcttacatcgtgaccaacggtacatcgacctcgaacaagatcgtcggtatgttctccgcgcctgcgggtagcacagtgctggtggatcgtaactgccataaatcattgactcacttaatgatgatgacggatgtaacgccaatttacttccgtccaacccgtaacgcttacggcattcttggtggtattccacagaacgaattcagccgtgaagtgattgcagagaaagtggcaaacaccccgggggcgagcgcaccaagctacgcggtgatcaccaactcgacttacgatggcctgctgtacaacactcagttcattaaagagtcgctggattgcaaacacatccacttcgacagtgcatgggtgccttacactaacttcaaccgtatttatgaaggcaagtgcggcatgagtggcgaagcgatgccgggtaaagtgttctacgaaacccagtccacgcacaaactgctggcggcgttctcgcaagcctcgatgattcatgtcaaaggtgagtttgaccgcgagtcgttcaacgaagcctttatgatgcacacctcaacctcaccgcagtacggcattgtggcatcgacggaaactgccgctgcaatgatgcgtggcaacaccggccgtaagcttatgcaggattcgattgatcgtgcgattcgcttccgtaaagagatcaaacgtctgaaaggcgagagcgaaggctggttcttcgatgtgtggcaacccgagaacattgagaccaccgagtgctggaaactcgatccaaaccaagattggcacggcttcaagaatcttgatgacaaccacatgtaccttgaccccatcaaaatcactctgctgactccgggaatgagcaaagatggcgaattggagcagagcggtattccggcatcactggtctctaaataccttgatgaacacggtatcgtggttgagaaaactggcccttacaacctgctgttcctgttctctatcggtattgataagtcaaaagcgatgcagttgctgcgcggcttgacggagttcaaacgcggttacgatctgaacctgaccattcgtaccatgctgccttcactgtaccgtgaagacccagttttctacgaaggcatgcgtattcaagagttggcgcaaggcattcacgacttaactcgtaaataccaattgccagagctgatgtacaaagcgttcgatgtgctgccagagatgaaagtgacgccacacgtggcatggcaacaagagctgcgcggtcaaactgaagagatcctgcttaacgagatggtgggtcgcgtgagcgccaatatgatcctgccttatcctccaggcgtgccattggtactgccaggtgaaatggtgacagacagctctcgccctgtgttggatttcttggaaatgctgtgcgaaatcggcgcgcattacccaggttttgagaccgacattcatggtttgtatcgccaaaaagatggctcttacaccgtaaaagtgctgaaggactaa

SEQ ID NO: 313 - protein, 733 aa, Vibrio cholerae
MALVLLTVQCTESAFFRLGDVQMNIFAILNHMGVFFKEEPVRQLHAALEKAGYDVVYPVDDKDLIKMIEMNPRICGVLFDWDKYSLELCERISKVNEKLPVHAFANEQSTLDISLTDLRLNVHFFEYALGMADDIAIKINQATQEYKDAIMPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQNEFSREVIAEKVANTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESEGWFFDVWQPENIETTECWKLDPNQDWHGFKNLDDNHMYLDPIKITLLTPGMSKDGELEQSGIPASLVSKYLDEHGIVVEKTGPYNLLFLFSIGIDKSKAMQLLRGLTEFKRGYDLNLTIRTMLPSLYREDPVFYEGMRIQELAQGIHDLTRKYQLPELMYKAFDVLPEMKVTPHVAWQQELRGQTEEILLNEMVGRVSANMILPYPPGVPLVLPGEMVTDSSRPVLDFLEMLCEIGAHYPGFETDIHGLYRQKDGSYTVKVLKD

SEQ ID NO: 314 - DNA, 2163 bp, Vibrio cholerae
  CDS (1)..(2163)
atgaattcattaaaaattgctacgagtttatcggttcgctcttgcttcacaacccaacgtgaagtggtggatgtactgaaaaccgacttctgtgacattggtgcggcggtggtttccgtcgaagacgtacaaaacggcatcatagataaaatgaatgcgaccggtttgaaactgccgatctttgttgctgtgtgctgcgaagaccaattcccagatgatttttgcgccgatatcaccggggtatttgagctgtgtgatgccaaagtcgagttctacggtaagcaagtggaaactgccgtgcgtcgttatcaagaaagtttgttgccacctttctttggtacattgaaaaaatacgtggacatgggtaactccacttttgcttgcccaggccatcaaggtggtcagttcttccgtaagcacccggttggtcgccagttttttgatttctttggtgaaaccttgttccgctctgatatgtgtaacgcggacgtacgtttgggcgacttgctgatccatgaaggtgcaccgcatgatgcacaggcttacgccgcgaaagtgtacaacgcggataaaacctacttcgtacttaacgggacttcagcttccaacaaagtggtgtgtaacgccctgctgacaccgggagatctggtgctgtttgatcgcaacaaccataaatccaaccaccacggtgcgttaattcaagcgggtgcgacaccggtttacttagaaacggcgcgtaacccattcggttttatcggtgggattgatacgcactgctttaacgaatcttacctacgtgatgcggtacgtaatgtcgacccaagccgcgcggaagcgaaacgcccattccgtcttgccatcattcagcttggcacttacgacggtacgatttacaacgcgcgtcaggtggtggatcgcatcggtcatttgtgtgactacatcctgtttgactcagcatgggtgggctatgaacagttcattcccatgatgaaagactgctcgccacttcttctcgatctaaagcctgaagatccgggcatcatcgtcactcagtccgtgcataaacagcaggcaggtttctcgcaaacttcgcaaattcacaagaaagatcaccacatcaaaggccaagagcgttactgcaaccataaacgctttaacaatgcctttatgctgcacgcttcaaccagcccattctacccgctgtttgcggcgctcgatgtgaacgccaagatgcacgaaggggacagtggccgctacctatggcgtgaagcggtaaaaaccggtatcgaagcccgtaagcttctaatgaaaaaatgcaaatacatcaagccgttcattccaccaatgatcgaaggtaaaccttggcagtctcaccccaccgagcaaattgccgatgatttacgtttctttgaatttgagccgggccagaaatggcatgcgtttgaaggttacgagcatggtcagtatttcgttgacccttgtaagttcctgctgaccacaccggggattgacccagaaactggcgaatacgagcactttggtattccggccaccatactggccaacttcctgcgtgagaacaacatcatcccagagaagtgcgatttgaactctatcctcttcctgctcaccccagccgaagatatggcgaagatgcagcatttagtggcacaaattgctcgttttgaacgcttgattgaagaagatgcaccactgagcgaagtattgccgaacgtgtaccgcgcgaatcgcgaacgctacaaaggctacaccatccgtcagttgtgtcaggaaatgcacgatctgtatgtcagccatgatgtgaaacagctgcaaaaagagatgttccgcgcgcgttatttcccacgtgcggtaatgaacccacaagaagcgaacttggcctttgtacgtggtcaggttgagctagtcccactgcgtgaagtggaaggccgtatcgccgctgaaggcgcactgccttaccctccgggtgtgttgtgtgtggttccgggagaaatatggggcggttcagtacagcgttacttcctcgctctagaagaaggcattaacttgctgccgggttttgcgcctgaattgcaaggggtgtatttggagccgacaggcgagggacgagtgcaagccatgggctatgtactgaaacgttaa

SEQ ID NO: 315 - protein, 720 aa, Vibrio cholerae
MNSLKIATSLSVRSCFTTQREVVDVLKTDFCDIGAAVVSVEDVQNGIIDKMNATGLKLPIFVAVCCEDQFPDDFCADITGVFELCDAKVEFYGKQVETAVRRYQESLLPPFFGTLKKYVDMGNSTFACPGHQGGQFFRKHPVGRQFFDFFGETLFRSDMCNADVRLGDLLIHEGAPHDAQAYAAKVYNADKTYFVLNGTSASNKVVCNALLTPGDLVLFDRNNHKSNHHGALIQAGATPVYLETARNPFGFIGGIDTHCFNESYLRDAVRNVDPSRAEAKRPFRLAIIQLGTYDGTIYNARQVVDRIGHLCDYILFDSAWVGYEQFIPMMKDCSPLLLDLKPEDPGIIVTQSVHKQQAGFSQTSQIHKKDHHIKGQERYCNHKRFNNAFMLHASTSPFYPLFAALDVNAKMHEGDSGRYLWREAVKTGIEARKLLMKKCKYIKPFIPPMIEGKPWQSHPTEQIADDLRFFEFEPGQKWHAFEGYEHGQYFVDPCKFLLTTPGIDPETGEYEHFGIPATILANFLRENNIIPEKCDLNSILFLLTPAEDMAKMQHLVAQIARFERLIEEDAPLSEVLPNVYRANRERYKGYTIRQLCQEMHDLYVSHDVKQLQKEMFRARYFPRAVMNPQEANLAFVRGQVELVPLREVEGRIAAEGALPYPPGVLCVVPGEIWGGSVQRYFLALEEGINLLPGFAPELQGVYLEPTGEGRVQAMGYVLKR

SEQ ID NO: 316 - DNA, 2349 bp, Sinorhizobium meliloti
  CDS (1)..(2349)
atgaaggctccgaccgtccccattccattccacaagctgctcaaggtcgtggcattcgtcgacgaaagcaatctggaaacgaagagacttcttgcgcacattgtcgcggaaaatttcgaagtcgagttgcgcggcagctataacgccgacgtgtccgaggacgcttcggttggtgcctatattgggacggtcgagggcggacggctcgaagatgcccgcaagttcgtccgtgcggtcagagacatcggattccgcacgccgctatgggccctcgcagactcccacggcattgcggacattgcggcgattaaaatggccggtgaagtggacggcttcgtttatcttgggcagcagacaccggcgttctacgcaaagcagatcatttcaagtctggtcaattacggcaagacgctcctcccgccgtttttcggcggcctcatggcttacgatggagaagccaacatcgcgttcgactgtccaggacaccaaggcggacagttttaccggaagtcgcccgcaggccagctctttttcaattatttcggcgaaagcatatttcgcgccgatctttgcaatgccgacgtcgaccttggcgacctgctaatccatgaagggccggcggccgaggcgcagaagaatgcggcaaggattttcggcgcggaccggacctacttcattctgaacggcacaagcacatcgaacaaagtggttacgaacgcggtactgcgcgcaggcgacctcgtgttgttcgaccgcaacaatcacaaatcgcttcatcagggcgcgctggtgcaggcgggagcgataccagtttacctgccgacctcacgcaactcgttcgggatgatcggtgccgtggactgggacgcctgggacgaagcgagcctgcgccggcagatcgaaaggcatcccctggtcgaggacaaggcgcgagccagtgcagagcgaccgttccgactcgcctgcatccaacttgcgacctatgacggcactatttacaacgtccgcaaggtgttggaacagatcggacacctgtgcgactacgtactctgggacgaggcgtggatcggctacaacgctttccacccgttgtttgaagaccacagtccgatgcggatcgacacgcttgatgccgaaatgccggggttgttctcaacgcaatccgtccacaagcaaggggcgggcttttcgcaagcctcgcagattcacaagcgcgacgagcacatccgtgatcagcgccgctacgtcgaacataagcgcttcaacgagtcgcttctcatgcatgtttcgacttcaccattctacccgctattcgcctcgttggacgtcaatgccaagatccacgagggcaaggctggtgaaatgctctgggatcgctgtatcgagctgggtatcgaggcacgcaagaagctcagagaattcacccggtactacgagtcgtcgggtgcggggccccaggagcagtggttcttcgaccccttcgtacccgatgtggtcacgatctcgggctccaaacataccgaggatgttgtcgagtcccgttgggaggcgctcccgacggaggtcatcaaacgggaacagcagtgctggcgcttccgtccaggggcttcatggcatggatattccggctactccgatggctacgcaatggtggatccaaacaagcttacgcttctcactccaggcatagaccgtgcgaccggggagtatcgagacttcggcatcccagcaacgatggttgccaattatcttcgcgaacagcgcatcgttcccgagaagtgcgacctcaacagcatactgtttctgctcacacctgccgaggacgagagcaagctcaacacgctgatagccaagttggtgaagttcaagaacttatgggatcgggacgcacctttggccgaggttctaccaaccgtgtttgcggcgaacagagagcgctatgcaggatacacactccggcaggtctgcgcagagatgcacgacttctatcggcaagcaggggtcaaggaattgcagcgcctctgcttcagggcggagagcatgcccgagcccgcaatgacgccgaaagcggcttatgaagccctcgtggcaaacgaagttgattatgtggcactcgacgaggctttcggcaggatttcggccacgctcgcgttgatctacccgccgggcataggcgtcatagtccccggggagcgctgggacgaaagggcgcggccgatgcacaactatttcctggcattccaagagtccttcaaccgcttccccggcttcaattacgaggtccagggtgtgtttcaggagcgcgttgacggccagatcaaattctacacctacgccgtgcgcgagtaa

SEQ ID NO: 317 - protein, 782 aa, Sinorhizobium meliloti
MKAPTVPIPFHKLLKVVAFVDESNLETKRLLAHIVAENFEVELRGSYNADVSEDASVGAYIGTVEGGRLEDARKFVRAVRDIGFRTPLWALADSHGIADIAAIKMAGEVDGFVYLGQQTPAFYAKQIISSLVNYGKTLLPPFFGGLMAYDGEANIAFDCPGHQGGQFYRKSPAGQLFFNYFGESIFRADLCNADVDLGDLLIHEGPAAEAQKNAARIFGADRTYFILNGTSTSNKVVTNAVLRAGDLVLFDRNNHKSLHQGALVQAGAIPVYLPTSRNSFGMIGAVDWDAWDEASLRRQIERHPLVEDKARASAERPFRLACIQLATYDGTIYNVRKVLEQIGHLCDYVLWDEAWIGYNAFHPLFEDHSPMRIDTLDAEMPGLFSTQSVHKQGAGFSQASQIHKRDEHIRDQRRYVEHKRFNESLLMHVSTSPFYPLFASLDVNAKIHEGKAGEMLWDRCIELGIEARKKLREFTRYYESSGAGPQEQWFFDPFVPDVVTISGSKHTEDVVESRWEALPTEVIKREQQCWRFRPGASWHGYSGYSDGYAMVDPNKLTLLTPGIDRATGEYRDFGIPATMVANYLREQRIVPEKCDLNSILFLLTPAEDESKLNTLIAKLVKFKNLWDRDAPLAEVLPTVFAANRERYAGYTLRQVCAEMHDFYRQAGVKELQRLCFRAESMPEPAMTPKAAYEALVANEVDYVALDEAFGRISATLALIYPPGIGVIVPGERWDERARPMHNYFLAFQESFNRFPGFNYEVQGVFQERVDGQIKFYTYAVRE

SEQ ID NO: 318 - DNA, 2853 bp, Mycobacterium leprae
  CDS (1)..(2853)
atgaatcgagacagtggccatccgcgacgacttcgtgtttccgcgctggcggcagtagccaacccgtcatacacgcgcattgacacgtggaacgtgctcgatgacgcctgccgtcacttggctgaggtcgaccgcgccgggctggacaccgcccacgatgttgcgcgtgttaagcgtttgctcgaccgcatcggtgcctacgaacggtactggctgtaccctggtgcggcaaatctggcggcgttccgcggctatcttgccaccatggcgacggttcagcttaccgaagaggtatcgctggccgtccgtctgttgtctgaatatggtgaccgcacagcgctttttgatacttcagcgccgctggccgaccaggagctggtggcccaagccaagcagcaacagttctacaccgtgttgctcgccgacgatgccccatccacggctcccgactgtctggcagagagcttgcgggagctgcgcaatccatccgacgatgtgcagttcgagctccttgttgtgtccagtgttgaggacgccatcaccgcggtcgcgctgaacggcgagattcaggctgcgatcatccgccatgacctgccactgcggtcccgcgaccgggtgccgttgatgaataccttgcttggggccaacgactcggagggcgcactggtcaccattgaccgcccacacgactgggtcgaatgcggtgagtggatcagggagctgcggccccatatcgacctctatctgctcaccgacgagtcgatcgcggcgggcaatgatgacgagcccgatgtctacgaccggacgttttatcgactcaacgacgttaccgacctaaacagcaccgtacttgcaggcttgcgaaaccgtttcgccacaccatttttcgatgccttgcgcgcctacgcagcagcaccggtcggccaattccatgctcttccggtcgcgcgtggtgccagtatctttaactctaggtcgctgcaagacatgggcgagttctacggtcggaacatcttcatggccgagacatcgaccacctctggtggcctggattcgttgctggatccgcacggcaacatcaaaaaagcgatggacaaagccgcagttacttggcgcgccaaccacacctactttgtcaccaacggaacttccacagccaacaaaatcgtcgtacagtcgttgacccggccaggtgacattgtacttatagaccgcaactgccacaagtcgcaccattatggcctggtattggctggtgcatacccgatgtacttggatgcttatccgttgccgcagttcgcgatctatggagcggtatcgctgcgcacaatcaagaaggcgctgctggatctagaggcagtccgacaactggatcgggtccgcatgttgttgctcaccaactgcacttttgatggcgtcgtctgtaacccgcagcgggtaatggaggaggtgctggcgatcaagccagacatttgcttcctatgggacgaggcgtggtatgcgtttgccactgccgtgccgtgggctcgtcagcggaccgcaatggtgtctgctgagcaactcgaacagaagttgtggtctgtcgaatacgccgaggaatatcggaattggtgcgcatcgatggccgagatccctcggtcccagtgggttgaccagcggctactgccggaccccaatcgggcgcggattcgcgtatatgcgacacactctactcacaagtcgctgtcggcgcttcggcaggcgtcgatgattcatgtccgcgatcaagatttcaatgcgctagcccgggatgcgttcggtgaggcattcttgacgcacacctcgacatcgccgaaccaacaacttctcgcgtcgttggatctggcgcgccgccaggttgacatcgagggatttcaactggtccggctggtgtacgacatggcgctggtctttcgtcaccgcgtccgcaaagaccggctgatcagcaaatggttccgtatcctcgatgaatccgacctggtgcccgacgagtaccgggcatcggcggtcagctcgtaccgtcaggttcggcagggtgctctggcggagtggaatgaggcatggcggtccgaccagttcgtgctggatccgacgagggtcaccttgttcgtcgggaagaccggaatgaacggatatgacttccgcgagaagatcttgatggagcgattcggcatacagatcaacaagacatccatcaacagtgtgctgttgatcttcaccatcggtgtcacgtggtcgagcgtgcattatctgctagatgtgttacgccgggtggccagtgactttgacaggattcagaaggtggccagcggggccgacctcgcgctgcatcagcgccatgttgaggagatcacccaggatttgccccacttgcccgacttcagcgagttcgatgttgccttccgtcccgaaaatgccagctcgttcggtgacatgcggtcggccttctacgccgggtacgaagaatcggaccgcgagtacgtgcatatcggcacggccgggcgtcagcttgctgaggggaggaccctggtgtccaccacgttcgtggtgccctacccgcccggcttcccggtactagtccctggtcaggtggtttctaaggagataatctacttcttggctcagctcgacgtgaaggaaattcacggatacaaccatgaactgggattatcagtattcactgagaaagcgttggctcggatgatcgcgaggcgcaacgcggcgtcggccgcggtgggttctgcgttcgcggctttcgagatcccatcggactctgctgctatgggcggggacgtgaacggcgacagagtcgaggctgttgcagaagacgcgtaa

SEQ ID NO: 319 - protein, 950 aa, Mycobacterium leprae
MNRDSGHPRRLRVSALAAVANPSYTRIDTWNVLDDACRHLAEVDRAGLDTAHDVARVKRLLDRIGAYERYWLYPGAANLAAFRGYLATMATVQLTEEVSLAVRLLSEYGDRTALFDTSAPLADQELVAQAKQQQFYTVLLADDAPSTAPDCLAESLRELRNPSDDVQFELLVVSSVEDAITAVALNGEIQAAIIRHDLPLRSRDRVPLMNTLLGANDSEGALVTIDRPHDWVECGEWIRELRPHIDLYLLTDESIAAGNDDEPDVYDRTFYRLNDVTDLNSTVLAGLRNRFATPFFDALRAYAAAPVGQFHALPVARGASIFNSRSLQDMGEFYGRNIFMAETSTTSGGLDSLLDPHGNIKKAMDKAAVTWRANHTYFVTNGTSTANKIVVQSLTRPGDIVLIDRNCHKSHHYGLVLAGAYPMYLDAYPLPQFAIYGAVSLRTIKKALLDLEAVRQLDRVRMLLLTNCTFDGVVCNPQRVMEEVLAIKPDICFLWDEAWYAFATAVPWARQRTAMVSAEQLEQKLWSVEYAEEYRNWCASMAEIPRSQWVDQRLLPDPNRARIRVYATHSTHKSLSALRQASMIHVRDQDFNALARDAFGEAFLTHTSTSPNQQLLASLDLARRQVDIEGFQLVRLVYDMALVFRHRVRKDRLISKWFRILDESDLVPDEYRASAVSSYRQVRQGALAEWNEAWRSDQFVLDPTRVTLFVGKTGMNGYDFREKILMERFGIQINKTSINSVLLIFTIGVTWSSVHYLLDVLRRVASDFDRIQKVASGADLALHQRHVEEITQDLPHLPDFSEFDVAFRPENASSFGDMRSAFYAGYEESDREYVHIGTAGRQLAEGRTLVSTTFVVPYPPGFPVLVPGQVVSKEIIYFLAQLDVKEIHGYNHELGLSVFTEKALARMIARRNAASAAVGSAFAAFEIPSDSAAMGGDVNGDRVEAVAEDA

SEQ ID NO: 320 - DNA, 2844 bp, Mycobacterium tuberculosis
  CDS (1)..(2844)
atgaacccaaacagcgtccgcccgcgacggctgcatgtctccgcgctggccgcggtggccaacccgtcctacacccgcctggacacctggaacctgctcgatgacgcgtgtcgtcacctggcggaggtcgacctcgccgggctcgacaccacacacgacgtggctcgggcgaagcggctgatggaccgcatcggcgcctatgagcggtactggctgtatccgggggcacagaatctggcgactttccgcgctcatctggatagtcattccacggtgcggcttaccgaggaagtgtcgttggccgtacgactgctgtccgaatacggcgaccgcacagcgctgttcgacacctccgcgtcactggcggagcaggagctggtagcgcaggccaaacagcagcagttctacaccgtgctgctcgccgacgactccccggcgacggctccggacagcttggccgagtgcctgcggcagttgcgcaatccggccgacgaggtgcagttcgagttgctcgtggtggccagcatcgaagatgccatcaccgcggtggcgctgaatggcgagattcaggcggcgatcatccgtcacgacctgccgctgcggtcccgcgaccgggtgccgctgatgaccacgctgctgggcaccgatggcgacgaagcggtggcaaacgagacccacgactgggtggaatgcgccgagtggatccgtgagttgcggccccacatcgacctctatctgctcaccgacgagtcgatcgccgccgagacccaggacgagcccgacgtctacgaccgcaccttctaccggctcaacgacgtcaccgacctgcacagcacggtgctcgcgggtttacgaaaccgttatgccacaccgtttttcgatgcgctgcgggcctatgcggcggcgccggtcggccaatttcatgcccttcccgtcgcgcgcggcgccagcatcttcaactccaagtcactgcacgacatgggcgagttctacggccgcaacatcttcatggccgagacctcgacaacctctggtggactggactcgctgctggacccgcatggcaacatcaagacggcgatggacaaagccgcggtgacctggaacgccaaccagacctacttcgtcaccaacggaacatcgaccgccaacaagatcgtcgtgcaggccctgacccgccccggcgacatcgtgctcatcgaccgcaattgccacaagtcgcaccactacggcctggtacttgccggcgcgtacccgatgtacctcgacgcatatccgctgccgcagtacgcgatttatggtgccgtgccgttgcgcaccatcaagcaggcgctgctggacctcgaggccgccggacagctgcaccgggtgcgcatgctgttgctcaccaactgcacgtttgacggcgtggtgtacaacccgcgccgggtgatggaggaggtgctagcgatcaaaccggacatctgctttttgtgggacgaggcgtggtatgcgtttgcgacggcggtgccctgggcccggcagcggaccgcgatgattgctgccgagcgactcgagcagatgttgtccactgcggaatacgctgaggaataccggaattggtgtgcgtcgatggacggagtggaccgctccgagtgggttgatcaccggctgttgccagaccccaaccgcgctcgggtccgagtgtatgcgacgcattcgactcacaagtcgctgtccgcgctacggcaggcatcgatgatccacgtgcgcgaccaggatttcaaagcgctcacccgggacgcgttcggtgaggcattcttgacccacacctcgacctcgcccaaccagcaacttctcgcctcgttggacttggcgcgccgacaggttgacatcgaagggttcgagctggtccgccatgtttacaacatggcgctggtgttccgccatcgcgtccgcaaagaccggctgatcagcaagtggttccgcatccttgacgagtccgacctggttcccgatgcctttcggtcctcgacggtcagctcgtaccgtcaggtcaggcagggggctctggccgattggaacgaagcctggcggtccgatcaattcgtgctcgatccgacgcggctcaccctgtttatcggggcgaccgggatgaacgggtacgacttccgcgagaagatcctgatggagcgattcggcatccagatcaacaaaacgtctatcaacagcgtgttgctgatcttcacgatcggcgtcacctggtcgagcgtgcactatctgctcgatgtgttgcgtcgggtggcgatcgatctggaccgcagccagaaggcggccagcggggccgaccttgctctacaccgacgccacgtcgaggagatcacgcaggatctgccgcatctaccagatttcagcgagttcgaccttgccttccgccccgacgacgccagctctttcggtgacatgcggtcggctttctacgccggctacgaagaggccgaccgtgagtacgtgcagatcggcttggccgggcgccggctggctgagggcaagactctggtatccaccacgttcgtggtgccctacccgcccggcttcccggtactggtgccgggtcaactggtttccaaggagatcatctactttcttgcccagctcgacgtcaaagagatccacggatacaaccccgacctggggttgtcggtgttcacccaggcggcattggcccggatggaggccgcgcgcaacgccgtcgccacggtaggtgccgcgctgccggccttcgaggtaccgcgggacgcttcggctttgaatggcaccgtcaacggcgacagtgtgctgcagggggtcgccgaagacgcgtaa

SEQ ID NO: 321 - protein, 947 aa, Mycobacterium tuberculosis
MNPNSVRPRRLHVSALAAVANPSYTRLDTWNLLDDACRHLAEVDLAGLDTTHDVARAKRLMDRIGAYERYWLYPGAQNLATFRAHLDSHSTVRLTEEVSLAVRLLSEYGDRTALFDTSASLAEQELVAQAKQQQFYTVLLADDSPATAPDSLAECLRQLRNPADEVQFELLVVASIEDAITAVALNGEIQAAIIRHDLPLRSRDRVPLMTTLLGTDGDEAVANETHDWVECAEWIRELRPHIDLYLLTDESIAAETQDEPDVYDRTFYRLNDVTDLHSTVLAGLRNRYATPFFDALRAYAAAPVGQFHALPVARGASIFNSKSLHDMGEFYGRNIFMAETSTTSGGLDSLLDPHGNIKTAMDKAAVTWNANQTYFVTNGTSTANKIVVQALTRPGDIVLIDRNCHKSHHYGLVLAGAYPMYLDAYPLPQYAIYGAVPLRTIKQALLDLEAAGQLHRVRMLLLTNCTFDGVVYNPRRVMEEVLAIKPDICFLWDEAWYAFATAVPWARQRTAMIAAERLEQMLSTAEYAEEYRNWCASMDGVDRSEWVDHRLLPDPNRARVRVYATHSTHKSLSALRQASMIHVRDQDFKALTRDAFGEAFLTHTSTSPNQQLLASLDLARRQVDIEGFELVRHVYNMALVFRHRVRKDRLISKWFRILDESDLVPDAFRSSTVSSYRQVRQGALADWNEAWRSDQFVLDPTRLTLFIGATGMNGYDFREKILMERFGIQINKTSINSVLLIFTIGVTWSSVHYLLDVLRRVAIDLDRSQKAASGADLALHRRHVEEITQDLPHLPDFSEFDLAFRPDDASSFGDMRSAFYAGYEEADREYVQIGLAGRRLAEGKTLVSTTFVVPYPPGFPVLVPGQLVSKEIIYFLAQLDVKEIHGYNPDLGLSVFTQAALARMEAARNAVATVGAALPAFEVPRDASALNGTVNGDSVLQGVAEDA

SEQ ID NO: 322 - DNA, 1548 bp, Pseudomonas aeruginosa
  CDS (1)..(1548)
atgtctcgaaacaatccttcgcgtcattcaatactcgtcacttccaacataaacgcggccaatgatgcgaatcgtctttccgagctttgtcgacaactggaaatacgcggctatcggctcttccaggcgccaagccgcaaggtcgccctggattttctcggcaacgccgcgcaccccgccggcatcctcctgctcgtcgcggagccgacaggcgagaacgaggccgcacaattggcggccctcgatgaactccgccaggtcgcgccgtccatcccgctgttcctgttgtttcgtcaactgcgcatcgagcagttgtccagccagctactggacgaggcccagggatgcttcaacctggccgccggccccgcacgcttcatcgccgagcgcatcgacagcgacctgcgcgaatggcgcgccccggcaggccccaggcggctgcgcgactatgccccgccggtcccgcgcacgccggtgagcgcccgctacaacggccgcgcacgcctcgacttggcgccggccaagcagtggcggatcggctcggggagcaccgcggagcgcctggcgacaccgctgaacgacctctccacggcctaccgcaagacgtccgcaggagccccggcggcgcacgccggcgacatcgccgaggcctttcgccgggcgctctgggaagccgctgcgcggctcgccagggaggatggcgatacgtggttcttcgagatactgcggggcaacccggggcctggcatcgaggccggccgggagacgccggcgaagcgctggcacgggctcgccgagacactcgacagcagtcctcggctggacccgctgcgcgtcgccctgagcgcccccggcctcgattcgcgcggtcgcccggccagcttcggagtacccgccgcggtggtctgccgctacctgcgccggcacggcatcgccccgttgcgcaccggcgactatcgcttcctgctgctgtttccccagggcgccagggcggaacacgcgcagccgctggtggacaggctgtgcgaattcaaacgccggcacgacgacgatgcgccgctgaagcaggtgttgccggagttgctcgacagctcgccgctgtaccgctacatcggcctgcgcgaactctgcgcgatgatccacgaagccagcctgcggctgcacctgaccgccctcgccgacgccgccgccagggctgccggccacgccgcgctggcgccggccacggtctatgggcacctggtcagggacgaaaccgaagcggtggcgatcgacaggctcggcggccgtgtggtcgccagcctggtcggcgtccatccggcggccacgccgctgctgttgcccggcgaacgggtggccgaggaatcaccggcgctgatcgactacctgctggccttgcaggccttcggcgagcactttcccggtttcgctcccgagttgcagggcatcgagatcgatgagcgcggccgctaccgggtccgttgcgtcaggccggcagccctcgcccgcggctccggcctgcgcctggccacgcgccggccggactaa

SEQ ID NO: 323 - protein, 515 aa, Pseudomonas aeruginosa
MSRNNPSRHSILVTSNINAANDANRLSELCRQLEIRGYRLFQAPSRKVALDFLGNAAHPAGILLLVAEPTGENEAAQLAALDELRQVAPSIPLFLLFRQLRIEQLSSQLLDEAQGCFNLAAGPARFIAERIDSDLREWRAPAGPRRLRDYAPPVPRTPVSARYNGRARLDLAPAKQWRIGSGSTAERLATPLNDLSTAYRKTSAGAPAAHAGDIAEAFRRALWEAAARLAREDGDTWFFEILRGNPGPGIEAGRETPAKRWHGLAETLDSSPRLDPLRVALSAPGLDSRGRPASFGVPAAVVCRYLRRHGIAPLRTGDYRFLLLFPQGARAEHAQPLVDRLCEFKRRHDDDAPLKQVLPELLDSSPLYRYIGLRELCAMIHEASLRLHLTALADAAARAAGHAALAPATVYGHLVRDETEAVAIDRLGGRVVASLVGVHPAATPLLLPGERVAEESPALIDYLLALQAFGEHFPGFAPELQGIEIDERGRYRVRCVRPAALARGSGLRLATRRPD

SEQ ID NO: 324 - DNA, 1641 bp, Oryza sativa japonica cultivar group
  CDS (1)..(1641)
atgcggcatgttgtagtacaatgtgccacttcatgggacactccaagaacgtctactactaatggttcacatgctgaaccttcagcagttgtcaaagctggtactgcccctctgattcaggcactgaaatcaactgcaaatcaagatgtttcttgctttcactttcctggacataatagagggaaagcttctcctccttcattgtcagaacttattggctcaaggacatttttgcatgacttacctgagctacctgagcttgatgatctcttctcccctaaaggtgtgattttagatgctcagaagcgagcagctgaactatttggatcatttaaaacatggttcctggtcaatggaagtacatgtggaatccaggcctcagtgatggctacctgttcccctggtgactacctcatcatacctcgaaattgtcatatttcagtgatctctgcactggttttgtctggtgctgtgcccaaatatatagtacctgagtacaattccgggtgggacattgctgggggtattaccccatcgcaggtggataaagtggttaaggaactggaggaggacagaaagaaggtaggtgctgttcttgttacatcaccaacctatcatggcatatgcagcaatatacaaggaattgtcaatgtttgccacctgcaaggcattcctgttatagttgacgaggcgcatggtgcccatttcaggtttcacagaaattttccaagcagcgcaactgagcaaggtgccgacttggttgtgcaatccacacacaaggttctgtgctcgcttacacagtcctcaatgcttcacatggctggagatcttgtggatgcagataaagtaagccaatgcctccaattgctccagagctcaagcccaagttaccttctactctcttctttggatgccgcaagggctcagctgagtgagaatgcagaatcttttgatgaaccagtatctatggctttagaaacaaaacatcagctgaggattatcccaggaatatctgttttggacttatcaagctttctttctgattttcctgctattgatcccttgcgtatcacattaagtgcttcagatctgcaattatctggatatgaagcagatgattttttagctgaggagcatcaaattgtatctgagctggtcggtacacaggccgtgacatttgcagtcaacttagggaccagaaggcatgatgttcagaggcttgtacattctgtaaagcatctgtcagaaaaatacttctctgaaaatgggtccagttccagaaaagagaatcctgctagtagcccactggacaagttctccatcaagttgacaccaagggaggccttctttttaaagaagaggagagtgtccatcgaggatagccttggtgagatttgtggtgagcttatctgcccttatccaccaggtatcccggtgctgatcccaggtgagatagtaacgcaggattcactgtcatacttgatggatgtcagggacaacggcatagcaatcagtggagcagctgatggtgagctcaagtccattatgctttcctctccagaacggaagcggaagcctcaatctgaacatagcatcaggtacaagtttgcacacctgcatggttctccagaagcatgttaa

SEQ ID NO: 325 - protein, 546 aa, Oryza sativa japonica cultivar group
MRHVVVQCATSWDTPRTSTTNGSHAEPSAVVKAGTAPLIQALKSTANQDVSCFHFPGHNRGKASPPSLSELIGSRTFLHDLPELPELDDLFSPKGVILDAQKRAAELFGSFKTWFLVNGSTCGIQASVMATCSPGDYLIIPRNCHISVISALVLSGAVPKYIVPEYNSGWDIAGGITPSQVDKVVKELEEDRKKVGAVLVTSPTYHGICSNIQGIVNVCHLQGIPVIVDEAHGAHFRFHRNFPSSATEQGADLVVQSTHKVLCSLTQSSMLHMAGDLVDADKVSQCLQLLQSSSPSYLLLSSLDAARAQLSENAESFDEPVSMALETKHQLRIIPGISVLDLSSFLSDFPAIDPLRITLSASDLQLSGYEADDFLAEEHQIVSELVGTQAVTFAVNLGTRRHDVQRLVHSVKHLSEKYFSENGSSSRKENPASSPLDKFSIKLTPREAFFLKKRRVSIEDSLGEICGELICPYPPGIPVLIPGEIVTQDSLSYLMDVRDNGIAISGAADGELKSIMLSSPERKRKPQSEHSIRYKFAHLHGSPEAC

SEQ ID NO: 326 - DNA, 1563 bp, Oryza sativa japonica cultivar group
  CDS (1)..(1563)
atgcggcatgttgtagtacaatgtgccacttcatgggacactccaagaacgtctactactaatggttcacatgctgaaccttcagcagttgtcaaagctggtactgcccctctgattcaggcactgaaatcaactgcaaatcaagatgtttcttgctttcactttcctggacataatagagggaaagcttctcctccttcattgtcagaacttattggctcaaggacatttttgcatgacttacctgagctacctgagcttgatgatctcttctcccctaaaggtgtgattttagatgctcagaagcgagcagctgaactatttggatcatttaaaacatggttcctggtcaatggaagtacatgtggaatccaggcctcagtgatggctacctgttcccctggtgactacctcatcatacctcgaaattgtcatatttcagtgatctctgcactggttttgtctggtgctgtgcccaaatatatagtacctgagtacaattccgggtgggacattgctgggggtattaccccatcgcaggtggataaagtggttaaggaactggaggaggacagaaagaaggtaggtgctgttcttgttacatcaccaacctatcatggcatatgcagcaatatacaaggaattgtcaatgtttgccacctgcaaggcattcctgttatagttgacgaggcgcatggtgcccatttcaggtttcacagaaattttccaagcagcgcaactgagcaaggtgccgacttggttgtgcaatccacacacaaggttctgtgctcgcttacacagtcctcaatgcttcacatggctggagatcttgtggatgcagataaagtaagccaatgcctccaattgctccagagctcaagcccaagttaccttctactctcttctttggatgccgcaagggctcagctgagtgagaatgcagaatcttttgatgaaccagtatctatggctttagaaacaaaacatcagctgaggattatcccaggaatatctgttttggacttatcaagctttctttctgattttcctgctattgatcccttgcgtatcacattaagtgcttcagatctgcaattatctggatatgaagcagatgattttttagctgaggagcatcaaattgtatctgagctggtcggtacacaggccgtgacatttgcagtcaacttagggaccagaaggcatgatgttcagaggcttgtacattctgtaaagcatctgtcagaaaaatacttctctgaaaatgggtccagttccagaaaagagaatcctgctagtagcccactggacaagttctccatcaagttgacaccaagggaggccttctttttaaagaagaggagagtgtccatcgaggatagccttggtgagatttgtggtgagcttatctgcccttatccaccaggtatcccggtgctgatcccaggtgagatagtaacgcaggattcactgtcatacttgatggatgtcagggacaacggcatagcaatcagtggagcagctgatggtgagctcaagtccattatggtatgcaacgtgtaa

SEQ ID NO: 327 - protein, 520 aa, Oryza sativa japonica cultivar group
MRHVVVQCATSWDTPRTSTTNGSHAEPSAVVKAGTAPLIQALKSTANQDVSCFHFPGHNRGKASPPSLSELIGSRTFLHDLPELPELDDLFSPKGVILDAQKRAAELFGSFKTWFLVNGSTCGIQASVMATCSPGDYLIIPRNCHISVISALVLSGAVPKYIVPEYNSGWDIAGGITPSQVDKVVKELEEDRKKVGAVLVTSPTYHGICSNIQGIVNVCHLQGIPVIVDEAHGAHFRFHRNFPSSATEQGADLVVQSTHKVLCSLTQSSMLHMAGDLVDADKVSQCLQLLQSSSPSYLLLSSLDAARAQLSENAESFDEPVSMALETKHQLRIIPGISVLDLSSFLSDFPAIDPLRITLSASDLQLSGYEADDFLAEEHQIVSELVGTQAVTFAVNLGTRRHDVQRLVHSVKHLSEKYFSENGSSSRKENPASSPLDKFSIKLTPREAFFLKKRRVSIEDSLGEICGELICPYPPGIPVLIPGEIVTQDSLSYLMDVRDNGIAISGAADGELKSIMVCNV

SEQ ID NO: 328 - DNA, 2139 bp, Moritella japonica
  CDS (1)..(2139)
atgaacattattgctattttaaaccacatgggcgtgttctttaaagaagagcctattcgtcaattacacaaatcgttagaagcatgtggatatgaagttgtttatccgcttgatgataacgacctagttaaaatgattgaaatgaatccacgtatctgtggtgctatctttgattgggataaatattctttagaattatgtgaaaaaattaataacttaaatgagaaacttccagttttcgcatttgcaaatgaacaatcagtacttgatatttcactcacagaccttcgcttaaatgtgtctttctttgaatatatgctaggtatgggtgatgatattgctctaaaaatcaatcaagcaattgacctttataaagatgaaataatgcctccatttactaaagcattatttaaatatgtagaagaaggtaagtatactttctgtacgccgggtcacatgggtggtactgcattccagaaaagcccagcaggtagtattttttatgatttttatggaccgaatgcttttaaagcggatgtatcaatctctatgcctgaattaggttcattattggatcactctggtccacataaagaagctgaagagtacattgcaaaaacatttaacgcagatcattcatatattgtaaccaatggtacttctactgcgaataaaattgttggtatgttctctgcaccatctggcagtactgtattagtagaccgtaactgtcataagtcattaactcaccttatgatgatgagtgatgttacacctatctacttccgcccgacgcgtaatgcatacggtattttaggtggtatcccacaaagtgaattcactcgtgaagttattgaagctaaagttgcagcaacaccgggtgctgaaatgccagattatgcagttatcactaactctacttatgatggcctgctttataacacgcaatttattaaagaaacactagatactaagtctattcactttgatagtgcttgggtaccatatactaactttaattctatttatgaaggtaagtgtggtatgagtggtgaagctatgccaggcaaggtgttctatgaaacacaatctacgcataaacttttagctgcattctctcaagcatcaatgatccacattaaaggtgaggttgataaagaaacctttaatgaagcatttatgatgcatacatcaacgtcaccacagtatggtatcgtggcatcagcagaaactgctgcagcaatgatgcgtggcaatactggcaaacgtttaattcaaggctctattgatcgtgctatccgtttccgcaaagaaattaaacgcttagaagcacaaagtgaaggttggttctttgacgtttggcaacctgaagatatcgaaacaacagaatgttggaagttagatccaaaagacgattggcatggctttaaagatattgatgataatcatatgtatcttgatccaattaaagtgacactattaacaccgggaatggggaaagatagcgaacttagtgagtctggtattcctgcagaacttgttgctaaattccttgatgaacgtggtattgttgtcgaaaaaacaggcccatacaacttattattcttgttctcaattggtattgataaagcaaaagcactggaattactacgtggactaacagaatttaaacgtggcttcgatcttaatctgaaagttaagagtttcttaccatcattatatgctgaagatccaagtttctatgaaggtatgaatattcaagatcttgctcaaggtattcataatatgattaagaagtttaagctacctgagctgatgtttaaagcgtttgatgtacttcctgaaatgaaggtcacaccgaacaaagcatgggaacaagaacttcgtggtaacacggaagaagttaaactagaggaaatggtaaatcgtgtaagtgctaatatgatcttgccgtaccctcctggtgtgccactaatccttcctggtgaaatggtaacagatacatcacgtccggtacttgaatttttagaaatgctatgtgagatcggtagtaagttccctggttttgaaacagatattcatggcgtataccttcaagatgatggtagctataccgttaaagtacttaaagaagattaa

SEQ ID NO: 329 - protein, 712 aa, Moritella japonica
MNIIAILNHMGVFFKEEPIRQLHKSLEACGYEVVYPLDDNDLVKMIEMNPRICGAIFDWDKYSLELCEKINNLNEKLPVFAFANEQSVLDISLTDLRLNVSFFEYMLGMGDDIALKINQAIDLYKDEIMPPFTKALFKYVEEGKYTFCTPGHMGGTAFQKSPAGSIFYDFYGPNAFKADVSISMPELGSLLDHSGPHKEAEEYIAKTFNADHSYIVTNGTSTANKIVGMFSAPSGSTVLVDRNCHKSLTHLMMMSDVTPIYFRPTRNAYGILGGIPQSEFTREVIEAKVAATPGAEMPDYAVITNSTYDGLLYNTQFIKETLDTKSIHFDSAWVPYTNFNSIYEGKCGMSGEAMPGKVFYETQSTHKLLAAFSQASMIHIKGEVDKETFNEAFMMHTSTSPQYGIVASAETAAAMMRGNTGKRLIQGSIDRAIRFRKEIKRLEAQSEGWFFDVWQPEDIETTECWKLDPKDDWHGFKDIDDNHMYLDPIKVTLLTPGMGKDSELSESGIPAELVAKFLDERGIVVEKTGPYNLLFLFSIGIDKAKALELLRGLTEFKRGFDLNLKVKSFLPSLYAEDPSFYEGMNIQDLAQGIHNMIKKFKLPELMFKAFDVLPEMKVTPNKAWEQELRGNTEEVKLEEMVNRVSANMILPYPPGVPLILPGEMVTDTSRPVLEFLEMLCEIGSKFPGFETDIHGVYLQDDGSYTVKVLKED

SEQ ID NO: 330 - DNA, 2136 bp, Vibrio vulnificus
  CDS (1)..(2136)
atgaatattttcgctatcttgaaccacatgggtgtgttctttaaagaagagccagttcgccaattgcatgcagcacttgaaaaagccggttatgaagttgtttatccagtggatgacaaagatttgatcaagatgatcgaaatgaacccacgcatttgtggtgtgctgtttgactgggataaatactcgcttgagctttgtgagcgtattagccaaatcaacgaaaaactgccagtacacgcgtttgctaacgagcaatcaacgctggatatttcgcttaccgatctacgcctaaacgtgcatttctttgaatacgctttgggcatggcggacgacatcgccatcaagatcaaccaagcgacacaagaatacaaagacgcaattacaccgccattcaccaaagcgctgtttaaatacgtggaagaaggcaaatacaccttctgtactccaggtcacatgggtggtacggcttttcaaaaaagcccagtcggcagcattttctacgatttctacggtccaaatactttcaaagcggacgtgtcgatttctatgccagagctaggctcactgcttgaccattcaggtccacacaaagaagcggaagagtacattgcgcgtacgttcaacgctgacgcatcgtacatcgtgacgaacggtacttcgacgtcaaacaaaattgtcggcatgttctctgcgccagcgggcagcacggtattggttgaccgtaactgtcataaatcattgactcacctaatgatgatgacggacgtaacacctatttacttccgcccaacccgtaacgcttacggcattcttggtggtattccacaaagtgaattcagccgtgaagtgatcgcagaaaaagtggctaaaacaccaggtgcgagcgcgccaagctacgcggtgattaccaactcaacttacgatggtttgttgtacaacacacaattcatcaaagagtctctcgactgtaaacacatccactttgatagtgcgtgggtgccttacactaacttcaaccgtatttacgaaggcaaatgcggcatgagtggcgaagcgatgccaggcaaagtgttctacgaaacacaatccactcacaaactgttggcggcgttctcgcaagcgtcaatgattcacgtaaaaggtgaatttgaccgtgagtcgttcaacgaagcctttatgatgcacacttccacctcgcctcaatacggcattgtggcatcaacagaaaccgcggcggcaatgatgcgtggtaacacgggccgtaagttgatgcaagattcaatcgaccgtgcgattcgtttccgtaaagagatcaaacgcttaaaaggtgaaagtgacggttggttctttgatgtttggcaaccagagaacattgagacaaccgaatgctggaaacttgaccctaaccaagactggcatggcttcaagaacatggacgatgaccacatgtatcttgacccaatcaaaatcactttgctgactcctggaatgagcaaagatggtgagttggaaaccagtggtattcctgcttcattggtggcgaaatatcttgatgaacgtggcattgtggtagaaaaaacaggcccttacaacttgttgttcttgttctcaattggtatcgacaaatcaaaagcgatgcaattgctacgtggtttgactgagttcaaacgtggttacgatctgaacctaacgattcgcaccatgctgcctgcgctgtaccgtgaagatccagcgttctacgaaggcatgcgtattcaagagctggcacaaggcattcacgatctgactcgtaagtaccgtctaccagaattgatgtacaaagcgttcgatgtgctaccagagatgaaagtcacgccacacgcagcttggcaacaagagcttcgtggtcaaaccgaagagatcttgctgaatgatatggtgggccgcgtgagtgccaacatgatccttccttaccctccaggtgtgcctctagtgctaccaggtgaagtggtgacagaaagctctcgtccagtactggacttcttggaaatgttgtgtgaaatcggcgcgcattacccaggcttcgagaccgacatacacggcctataccgccaaaaagatggccgttacaccgtaaaagtactgaaagactaa

SEQ ID NO: 331 - protein, 711 aa, Vibrio vulnificus
MNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVHFFEYALGMADDIAIKINQATQEYKDAITPPFTKALFKYVEEGKYTFCTPGHMGGTAFQKSPVGSIFYDFYGPNTFKADVSISMPELGSLLDHSGPHKEAEEYIARTFNADASYIVTNGTSTSNKIVGMFSAPAGSTVLVDRNCHKSLTHLMMMTDVTPIYFRPTRNAYGILGGIPQSEFSREVIAEKVAKTPGASAPSYAVITNSTYDGLLYNTQFIKESLDCKHIHFDSAWVPYTNFNRIYEGKCGMSGEAMPGKVFYETQSTHKLLAAFSQASMIHVKGEFDRESFNEAFMMHTSTSPQYGIVASTETAAAMMRGNTGRKLMQDSIDRAIRFRKEIKRLKGESDGWFFDVWQPENIETTECWKLDPNQDWHGFKNMDDDHMYLDPIKITLLTPGMSKDGELETSGIPASLVAKYLDERGIVVEKTGPYNLLFLFSIGIDKSKAMQLLRGLTEFKRGYDLNLTIRTMLPALYREDPAFYEGMRIQELAQGIHDLTRKYRLPELMYKAFDVLPEMKVTPHAAWQQELRGQTEEILLNDMVGRVSANMILPYPPGVPLVLPGEVVTESSRPVLDFLEMLCEIGAHYPGFETDIHGLYRQKDGRYTVKVLKD

SEQ ID NO: 332 - DNA, 2130 bp, Eikenella corrodens
  CDS (1)..(2130)
atgaagaacatcttattaggctgtggtcataaggaacttggtgactatctgaagagcttgattgaaactttggaaaagggtggtcacaccatccgaatagcccatgacccgcaagaaatcctgacgttcctgaaacatgacgccagaataggctcagtgctttgtacactggatattttcaaccgagaattagacgaacaaattattgcactcaacgatgagctacccgtattcattctgaagcccaccgactgcgacaaacccgtggacttcggcgctgtaggcgaccatgccaccttcatcgattgccatctgttcagcaacgaagacgttgttgataaaattgaaaaagcaatctgtcactatatcgacaatatcaccccgcccttcactaaagccctgtttgactacgttgataaaaacaaatacacattctgtactccgggtcacatgagcggtaccgctttcttgaaatctcccgtaggtagcctgttctacgacttctacggtgaaaacacattcaaatcagatatttcagtttctatgggcgaattgggctctctgctcgaccactccggcccgcacaaagaggccgaagaatacatcgccgaaaccttcaatgccgaccacagctacatcgtaaccaacggtacttccaccgccaacaaaatcgtgggtatgtactccgttccggccggcagcaccgtactgatcgaccgtaactgccacaaatcattaacccacctgttgatgatgagcgacattactccggtgtatctgaaaccgacccgtaacgcctacggtatcttgggtggtattccgcaaaaagaattcaccaaagaagttattaccgaaaaacttaccaaagttccgggcgccacttggccggtacatgccgtgattaccaactccacttatgacggcctgttctacaacaccgacaagatcaaagacaccctggatgtgaaatccatccacttcgactctgcttgggttccctacaccaacttcagcccgatctacaacggcaaaaccggtatgggcggtaagcaggttaaagacaaggtaatctttgaaacccactctacccacaaactgctggccgcattctcacaggcttccatgattcacgttaagggtaacctgaacaccgccaccttcggcgaagcctacatgatgcacacctccacttctccgttctaccccatggtagcctctactgaagtggcagcagccatgatgcgcggcaactccggtaaacgcctgatgcaggattcactggaacgcgccgttaaattccgtaaggaaatcaagaaacacaaagcccatgccgactcatggtatttcgatgtatggcaacctgaaaatgttgacaacatcgaatgctgggaattgcatcagaccgacaaatggcacggcttcaaagacatcgacgcccagcacatgtacctcgacccgattaaggtaactctgcttaccccgggcttggataaaaacggcgagctggaaaaaaccggtatccccgccaacctcgtttccaaattcttggaagaccgcggcatcatcgtggagaaaaccggcccctacaacatcctcgtgctcttcagcatcggcgtggacgacaccaaagccctcagcctgctgcacgcattgaacgagttcaaatccctgtacgatgccaacgccaccgtagaagaagtattgccgcgcgtattcaacgaatcgccctctttctaccaagaaatgcggattcaagaattggcacaaggcatccacagcctgatctgcaaacacaacctgcctgaactgatgttcagcgcattcgaagtgttgccgaccatggtgatgaacccgcacaaagccttccagcttgagctgaaaggtcagattgaagactgctacttggaagacatggtaggcaagatcaacgccaacatgattctgccctatcctcccggcgtaccgttggtaatgcctggtgaaatgatcaccgaagaaagcaagcccatcttggaattcctgatgatgctgtgcgaaatcggcgcccacttccccggcttcgaaaccgacatccacggtgcttaccgtcaagaagacggccgctataaagttaagattgttaaagcttaa

SEQ ID NO: 333 - protein, 709 aa, Eikenella corrodens
MKNILLGCGHKELGDYLKSLIETLEKGGHTIRIAHDPQEILTFLKHDARIGSVLCTLDIFNRELDEQIIALNDELPVFILKPTDCDKPVDFGAVGDHATFIDCHLFSNEDVVDKIEKAICHYIDNITPPFTKALFDYVDKNKYTFCTPGHMSGTAFLKSPVGSLFYDFYGENTFKSDISVSMGELGSLLDHSGPHKEAEEYIAETFNADHSYIVTNGTSTANKIVGMYSVPAGSTVLIDRNCHKSLTHLLMMSDITPVYLKPTRNAYGILGGIPQKEFTKEVITEKLTKVPGATWPVHAVITNSTYDGLFYNTDKIKDTLDVKSIHFDSAWVPYTNFSPIYNGKTGMGGKQVKDKVIFETHSTHKLLAAFSQASMIHVKGNLNTATFGEAYMMHTSTSPFYPMVASTEVAAAMMRGNSGKRLMQDSLERAVKFRKEIKKHKAHADSWYFDVWQPENVDNIECWELHQTDKWHGFKDIDAQHMYLDPIKVTLLTPGLDKNGELEKTGIPANLVSKFLEDRGIIVEKTGPYNILVLFSIGVDDTKALSLLHALNEFKSLYDANATVEEVLPRVFNESPSFYQEMRIQELAQGIHSLICKHNLPELMFSAFEVLPTMVMNPHKAFQLELKGQIEDCYLEDMVGKINANMILPYPPGVPLVMPGEMITEESKPILEFLMMLCEIGAHFPGFETDIHGAYRQEDGRYKVKIVKA

SEQ ID NO: 334 - DNA, 2127 bp, Escherichia coli
  CDS (1)..(2127)
atgaataccatattgattggtagtaagtcttttgacaataaatatgtggcagaaatcatttctcatttacatacaaaaaattttggcactgaactggctggttgtagtgagaaaattgaaaccattataagaaacaacgcaagaatcgctgcagtattactggatttggatgattcgaatgatattcttgacaaaattcgcatgctgaatgaacatctgccagtcttcttacttaagaccgatgatgttgccattaaaaaattttgttttgattcattcgacggaaatgtacatcttattgattgttgcctttattctgttgacgaaattgttaataaaatccagaaaataattaatgactatattgatgcaatattaccacctttaacaaaagcattatttaactatgtgaaggaaggtaaatatactttctgtacgccaggacacatgggaggaacagcttaccagaaatcgcctgcaggtagtttgttctatgatttttttggtgaaaataccatgaaatcagatatttcagtgtctgtcggagaactggggtcgctgcttgatcactcaggacctcattcagaagccgaaaagtatattgctgaaacttttaatgctgacagaagctatattgttacgaacggaacgtcgacagctaataaaattgttgggcaattctccgtacctgcaggatgtactgcactgattgacaggaattgccacaaatctctcacacatatgttgatgatgagtgacatcatcccgatatatctgaaacctacacgaaatgcatatggcattctgggggggatccccagaacggaattctcttctgattcgattaagcagaaaatggctgttacgccaggtgcaacatggccagttcatgccgttatcactaactctacttatgatggtctgttttataataccgactggatcaaagaacatctggatgtaaaatctattcattttgattccgcatgggtgccatataccaatttcagtccgatttattctggcaaaacgggtatgggtggcaagcgtattgaaggaaaagtaatatatgaaacgcagtcaacgcataagctgttagccgctttttcacaggcatccatgattcatgttaaaggtgatattaatgaagaaacctttaatgaagcctatatgatgcaaacctccacctctcctcattacggtattgtcgcctccactgaaatggctgcggctatgatgaaaggcaatcctggcaaacgtcttattcaggaatccatggaacgtgctctggcttttcgtaaggaaatccaggcccgctttgaaaacagtgacacttggttttttaaagtatggcaacctgagaacattaatgaggtagattgctggccattggataaaaacgatcaatggcatggattcaaagatattgatcaagaacatatgtatcttgaccccattaaagtaactttattgacgccgggtcttgataaatacgggaaaattgaagaacaaggtatacccgcagcattagtttcaaaattcctagatgatcgtggtattattgtcgaaaaaacaggtccatataacattttgttcctgttcagcattgggattgatgatactaaggctcttagtcttctgcatggtttgtatgaatttaaggagcggtacgatcgtaatgagctggtcaaagatattctgccagggatctgggccgaatcgccagctttttacaacaatatgagaattcaggagctggcacagggaattcataatctgattcgcaagcataatctgccggagttaatgttccgggctttcgatgtcctgccagaaatggtaatgaaacctcagcaggctttccaggcagaacttcgtggtgaaacggaggaatgtttcattgaagacttggtagggaaaattaatgctaatatgattcttccgtatccaccaggagtacctttagttcttcccggagaaatgattacagagagcaatcgtccggttctggagtttttgttaatgctttgtgaaattggtaaccactatcctggttttgaaaccgatattcatggtctgtatcgaaaggcggataacaggtatactgcaaaagtcattaaaaaataa

SEQ ID NO: 335 - protein, 708 aa, Escherichia coli
MNTILIGSKSFDNKYVAEIISHLHTKNFGTELAGCSEKIETIIRNNARIAAVLLDLDDSNDILDKIRMLNEHLPVFLLKTDDVAIKKFCFDSFDGNVHLIDCCLYSVDEIVNKIQKIINDYIDAILPPLTKALFNYVKEGKYTFCTPGHMGGTAYQKSPAGSLFYDFFGENTMKSDISVSVGELGSLLDHSGPHSEAEKYIAETFNADRSYIVTNGTSTANKIVGQFSVPAGCTALIDRNCHKSLTHMLMMSDIIPIYLKPTRNAYGILGGIPRTEFSSDSIKQKMAVTPGATWPVHAVITNSTYDGLFYNTDWIKEHLDVKSIHFDSAWVPYTNFSPIYSGKTGMGGKRIEGKVIYETQSTHKLLAAFSQASMIHVKGDINEETFNEAYMMQTSTSPHYGIVASTEMAAAMMKGNPGKRLIQESMERALAFRKEIQARFENSDTWFFKVWQPENINEVDCWPLDKNDQWHGFKDIDQEHMYLDPIKVTLLTPGLDKYGKIEEQGIPAALVSKFLDDRGIIVEKTGPYNILFLFSIGIDDTKALSLLHGLYEFKERYDRNELVKDILPGIWAESPAFYNNMRIQELAQGIHNLIRKHNLPELMFRAFDVLPEMVMKPQQAFQAELRGETEECFIEDLVGKINANMILPYPPGVPLVLPGEMITESNRPVLEFLLMLCEIGNHYPGFETDIHGLYRKADNRYTAKVIKK

SEQ ID NO: 336 - DNA, 2163 bp, Pasteurella multocida
  CDS (1)..(2163)
atgctaaatttaaaaattgcatatagcccattaattcgaccttattttcatacaaatagagaactcgtttctgttcaagaaacagatttcaccgacattggtgcaattatcctgagttctgaagatattgaagattatattgatagtatacaagcaactgaatttaatattccggtctttgttgctgtcattgaaggtcaatttttagatcctcaattctttgacaaagtctatcacgttcaagatctcaacaactacgacatcaacctatacagtcgccaaattgaaactgcggcgcggttttacgaagaaaaaatcctcccacctttctttaaaatgctaagtgaatatgtggaaatggggaattctgcttttgattgtccgggacaccaaggtggacaatatttccgtaaacatcctgcaggacgttatctctatgatttctacggtgaaaatattttccgctcagatatctgtaatgccgatgtaaaattaggcgatttgctaatccatgaaggagccgcttgtgatgctcaaaaacacgctgctcaagtctttaatgctgataaaacctacttcgtcttaaatgggacatcttctgcaaataaagtcgtcaccaatgcgttactcacaccgggtgatcttgtgctctttgatcgtaacaatcacaaatctatccatcacggtgcattaattcaagctggtgctacccctgtttatttggaaactgcgcgtaatccatttggttttatcggtgggatcgatagccattgttttgatgaagattatttgaaatctttaattaaagatgttgcgcctgaaaaactaacacaagcacgtcctttccgtttagccgttattcagctcggcacttatgacggaaccatctataatgcgcgccaagtcgtagataaaattggtcatttatgtgactacatcttgtttgattctgcgtgggtaggttatgaacaattcattccaatgatgaaagattgctcaccgctcttgcttgaattaaatgaaaatgatcccggcatcatcgtgacacaatcagtacacaaacaacaagccggcttctcacaagcctcacaaattcacaaaaaagacaagcacattaaaggtcaacagcgctactgtaatcataaacgctttaataatgcattcatgttacacgcctccaccagcccattctaccctctttttgccacacttgatgtcaatgcaaaaattcaaggtacccctgcgggtattcgtttatggcatgactgtgtcaaaatcgggatagaagcacgtaaaatggtgctgaatagttgtgatctgatcaaaccgtttattccgccttatgtcaatggcaaaaaatggcaagactacgatacagaagaaatggcaaatgatttaacattcttcaaattccatgctgatgataaatggcatcaatttgaaggctatgtagataaccaatattttgttgatccatgtaaattcatgctaacgacgccgggtattgatattgaaacaggtgaatacgaagacttcggtgtccctgctacgattcttgctaattatttacgtgaaaacggcattattccggaaaaatgtgacttaaactcaattctcttcttattaacgccagcagaaaccctcaccaaaatgcaaagtttggttgcacaaattgcggcatttgaacaacacatcaaaaaagattccttactaaaagaagtcttaccaagtgtttatcacaacaatgaaaaacgctatgaaggttataccatccgtcgtctttgccaagaaatgcatgatttgtatgtcagccgtaacgtgaaaactttacaacgcaacttattcagaaaagcgaccttgcctgaatatgtgatgaatccacatcaagctaatcttgaatttgttcgtaatcgtgtagaactggttccactaaccgaaatcgttaatcgcattgcggcagaaggagcacttccttatccaccgggtgtgctttgtgtcgtaccgggtgaaaaatggagtcagactgcacaggaatatttcttagcactcgaagaaggcattaatttattaccaggtttcgcaccagaaattcaaggggtatatctacaacaagatgcagatggacgtattcgtgcttatggctacgtattaactgaaaactaa

SEQ ID NO: 337 - protein, 720 aa, Pasteurella multocida
MLNLKIAYSPLIRPYFHTNRELVSVQETDFTDIGAIILSSEDIEDYIDSIQATEFNIPVFVAVIEGQFLDPQFFDKVYHVQDLNNYDINLYSRQIETAARFYEEKILPPFFKMLSEYVEMGNSAFDCPGHQGGQYFRKHPAGRYLYDFYGENIFRSDICNADVKLGDLLIHEGAACDAQKHAAQVFNADKTYFVLNGTSSANKVVTNALLTPGDLVLFDRNNHKSIHHGALIQAGATPVYLETARNPFGFIGGIDSHCFDEDYLKSLIKDVAPEKLTQARPFRLAVIQLGTYDGTIYNARQVVDKIGHLCDYILFDSAWVGYEQFIPMMKDCSPLLLELNENDPGIIVTQSVHKQQAGFSQASQIHKKDKHIKGQQRYCNHKRFNNAFMLHASTSPFYPLFATLDVNAKIQGTPAGIRLWHDCVKIGIEARKMVLNSCDLIKPFIPPYVNGKKWQDYDTEEMANDLTFFKFHADDKWHQFEGYVDNQYFVDPCKFMLTTPGIDIETGEYEDFGVPATILANYLRENGIIPEKCDLNSILFLLTPAETLTKMQSLVAQIAAFEQHIKKDSLLKEVLPSVYHNNEKRYEGYTIRRLCQEMHDLYVSRNVKTLQRNLFRKATLPEYVMNPHQANLEFVRNRVELVPLTEIVNRIAAEGALPYPPGVLCVVPGEKWSQTAQEYFLALEEGINLLPGFAPEIQGVYLQQDADGRIRAYGYVLTEN

SEQ ID NO: 338 - DNA, 2142 bp, Salmonella typhimurium
  CDS (1)..(2142)
atgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctttttacctacgccaaagaaggaaaatataccttttgtacgccgggtcatatggcgggaacggcgtatcagaaaagcccgccaggctgcctgttttatgacttttttggcggcaataccttaaaagctgatgtgtcgatttcggtgactgaactgggatcgctgctggatcacaccgggccgcatctggaagcggaagagtatatcgcccgtacttttggcgccgagcagagctatatggtgacgaacggtacgtcgacctcgaataaaattgtcggtatgtatgccgcgcctgcgggaagtacgctacttattgatcgtaattgtcataaatcgctggcgcatttgctgatgatgagcgatgtggtgcctctctggttgaagccgacgcgcaatgcgctcggcattctcggcggtattccccgaagggaatttacccgtgcaagcatcgaaagcaagatagaggagacccctcaggcgcaatggccggtgcatgcggttatcaccaattcgacttacgatggtctgctgtataacactaactggatcaagcaaatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttccacatcgccgagctatcccattgtcgcctctatcgagaccgcagcggcgatgctgcgcggcaatccagggaaaagattgattaatcgttcggtggaacgggcgctccattttcgtaaagaggtacagcggctacgtgaagagtccgatagctggttctttgatatctggcagccggaagaggttgatgaggccgaatgctggccggtcacgccgggagaaacctggcatggcttcaccgatgccgatgacgatcatatgttcctcgatccggttaaggtgacaatcctgacgccggggatggatgaacagggcaacatgagcgaagaggggatacccgccgcgctggtggcgaagttccttgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggggctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgctcgattggccagcattatcccggttttgaaacggatattcacggcgcgaaacggaatgaagacggggtgtaccaggtacgagtcttaaaacacgcctgctaa

SEQ ID NO: 339 - protein, 713 aa, Salmonella typhimurium
MNIIAIMGPHGVYYKDEPIKELERALQSLGFQIIWPQNSVDLLKFIEHNPRICGVIFDWDEYSLDLCSEINQLNEYLPLYAFINTNSTLDVSVHDMRMALWFFEYALGLAEDIATRIHQYTNEYLDNITPPFTKALFTYAKEGKYTFCTPGHMAGTAYQKSPPGCLFYDFFGGNTLKADVSISVTELGSLLDHTGPHLEAEEYIARTFGAEQSYMVTNGTSTSNKIVGMYAAPAGSTLLIDRNCHKSLAHLLMMSDVVPLWLKPTRNALGILGGIPRREFTRASIESKIEETPQAQWPVHAVITNSTYDGLLYNTNWIKQMLDVPSIHFDSAWVPYTHFHPIYQGKSGMSGDRVPGKVIFETQSTHKMLAAFSQASLIHIKGEYDEETFNEAFMMHTSTSPSYPIVASIETAAAMLRGNPGKRLINRSVERALHFRKEVQRLREESDSWFFDIWQPEEVDEAECWPVTPGETWHGFTDADDDHMFLDPVKVTILTPGMDEQGNMSEEGIPAALVAKFLDERGVVVEKTGPYNLLFLFSIGIDKTRAMGLLRGLTEFKRAYDLNLRVKNMLPDLYAEDPDFYRNMRIQDLAQGIHKLIRQHDLPGLMLRAFEVLPEMIMTPHQAWQRQIKGEVETVALDQLPGRVSANMILPYPPGVPLLMPGERITQQSRAVLDFLLMLCSIGQHYPGFETDIHGAKRNEDGVYQVRVLKHAC

SEQ ID NO: 340 - DNA, 2199 bp, Salmonella typhimurium
  CDS (1)..(2199)
atgtcagaattaaaaattgccgttagccgtcattgcccggattgtttttctacacaccgtaatattgtaaatgttgatgagagtcgtttcatcgacgtggctgccatcgtgttatccattgacgacattgaacacggaaaactcgatgaaatcgacgcaacgggttacggtattcccgtgtttgtcgcgacacatgacgaagggcgcgtaccgcctgagtatttgccgcgtatctctggtgtattcgaatataatgaatcccgtactgccttctatggtcgccagttggaaaccgcagcaagccactacgaaacgcagttacgtccgccgtttttccgcgcgctggtggattatgtcaaccagggcaacagcgcatttgactgcccggggcatcagggcggcgaattcttccgccgtcatcctgccggtaatcagttcgtggaatactttggcgaaacgctcttccgctccgacctatgcaacgcggacgtggcgatgggcgatctgctgattcacgaaggcgcgccttgcattgcgcagcaacatgcggcgaaagtctttaacgccgataagacctactttgtgctgaacgggacctcctcctctaacaaagtcgtactcaacgcgctgttaacgccgggcgatctggtactgtttgaccgtaacaaccacaaatctaaccaccacggcgcattattgcaggcgggcgcaacgccagtttatctggaaaccgcgcgtaacccgtatggttttatcggcgggatcgacgctcactgcttcgaagaagattacctgcgcgagctgattagcgaagtcgcgccgcagcgtgcccgcgaagcacgtccattccgtctggccgtcatccagttaggcacctacgacggtaccatttataacgcccgtcaggtcgtcgataaaattggtcatctgtgcgactacatcctgtttgactccgcctgggtcggctatgaacaatttattccgatgatggccgattgttcgccgctgctgctggaactgaacgaaaacgatccgggtattctggtgacgcagtccgttcacaaacaacaagccggtttctcccagacctcgcagatccataaaaaagatagccatatcaaagggcaatcgcgctacgttccgcataagcgcatgaacaacgcctttatgatgcacgcctccaccagcccgttctatccgctgttcgccgcgctggacgttaacgccaaaatgcacgaaggcgtcagcggtcgcaatatgtggatggattgcgtggttaacggcatcgatgcccgtaaattgatcctcgaaaactgtcatcacatccgtccgttcgtaccggaactgattgatggtaagccgtggcagtcatacccgacgtcagagatcgccagcgatctgcgcttcttccacttcgttccgggagaacactggcatgcgtttgaaggctatgccgaacatcagtactttgtcgacccttgcaaactgctgctcaccacaccgggcattaatgcagcgagcggcgaatatgaagactttggcgttcctgccacgatcctcgccaacttcctgcgcgagaacggcgttgtgccggaaaaatgcgacctcaactccattctgttcctgctgacgccggcagaagacatggcgaagttacaacagcttgtcgccctgctggctcgtttcgaaaaactgctggaagctgatgcgccgttagcggaagtattaccgtccatctacaaacagcatgaagcgcgttatgccggctataccctgcgtcagctttgccaggagatgcacgatctctatgcgcggcacaacgtgaaacagctgcaaaaagagatgttccgtaaatcgcatttcccgaaagtcagtatgaatccgcaagaggccaactatgcctatctgcgcggcgaggtcgaactggttcgcctgccggaagcggaaggtcgtatcgcggctgaaggcgctctgccttacccgccgggagtgctgtgtgtagttccgggtgaaatctggggcggttctgtcctgcgttacttcagcgccctggaagaagggatcaacctgctgccgggctttgcgcctgaactgcagggcgtttatatcgaagaacacgacggccgtaagcaggtctggtgctacgtcattaaacctcgtgacgcacagcgctccctgctgaaggaggaaaaattataa

SEQ ID NO: 341 - protein, 732 aa, Salmonella typhimurium
MSELKIAVSRHCPDCFSTHRNIVNVDESRFIDVAAIVLSIDDIEHGKLDEIDATGYGIPVFVATHDEGRVPPEYLPRISGVFEYNESRTAFYGRQLETAASHYETQLRPPFFRALVDYVNQGNSAFDCPGHQGGEFFRRHPAGNQFVEYFGETLFRSDLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEEDYLRELISEVAPQRAREARPFRLAVIQLGTYDGTIYNARQVVDKIGHLCDYILFDSAWVGYEQFIPMMADCSPLLLELNENDPGILVTQSVHKQQAGFSQTSQIHKKDSHIKGQSRYVPHKRMNNAFMMHASTSPFYPLFAALDVNAKMHEGVSGRNMWMDCVVNGIDARKLILENCHHIRPFVPELIDGKPWQSYPTSEIASDLRFFHFVPGEHWHAFEGYAEHQYFVDPCKLLLTTPGINAASGEYEDFGVPATILANFLRENGVVPEKCDLNSILFLLTPAEDMAKLQQLVALLARFEKLLEADAPLAEVLPSIYKQHEARYAGYTLRQLCQEMHDLYARHNVKQLQKEMFRKSHFPKVSMNPQEANYAYLRGEVELVRLPEAEGRIAAEGALPYPPGVLCVVPGEIWGGSVLRYFSALEEGINLLPGFAPELQGVYIEEHDGRKQVWCYVIKPRDAQRSLLKEEKL

SEQ ID NO: 342 - DNA, 2136 bp, Salmonella typhimurium
  CDS (1)..(2136)
atgaaatcaatgaatattgccgccagcggtgaactcattccccgtctctccacccaccgaaacgtagtggcgctggacagtaccgactttaccgatgtggccgcagtcgtcattaccactgccgacagccgtagcggtattctggcgttgcttaaacgcaccggttttcacctgccggtgtttatgcttgcggatgaacccgtcagcgcgcctgtcggcgttacggcggtaatagtcgggaacgcgcaggaatggctggagctggaaaacgctgcctgtcgctacgaagcggaacttctgccgcccttttatggcaccctgacccagtatgtcgacatggggaatagtacttttgcttgcccggggcaccagcatggcgaattttttagaaaacatcccgcaggccgccatttttatgacttttttggtgaaaacctgtttcgtgcggatatgtgtaacgccgatgtgaaacttggcgatctgctaatacatgaaggttctgccaaacacgcgcagaaatttgcggcaaaagtgtttaatgcggataaaacctactttgtgctgaatgggacttcggcggcgaataaagtggtcaccaacgccctgctgacgcgcggcgatctggtgctgtttgatcgtaataatcacaaatccaaccaccacggcgccctgattcaggccggggcgacgccagtctatcttgaagcggcgcgtaacccgtttggttttatcggtggcattgatgcgcactgttttgatgaaacgtacctgcgcgaccagattcgtgacgtgatgccggaaagcgccgatgcgtcgcgtccgttccgcctggcgatcattcagctgggtacctatgacggcactatttacaacgcccgtcaggtggtggataaaatcgggcatctctgcgattacattctgtttgactccgcgtgggtaggctatgagcagtttatcaatatgatggcggatacctcgccgttgcggctggagcttaatgaaaacgaccctgggatctttgtgacccaatcggtacataagcaacaggcggggttctcacaaacctcgcagatccacaaaaaagataaccatattcgcggccaggcgcgtttttgcccgcacaaacgcctgaacaacgccttcatgttgcatgcttcaaccagtccgttctacccgctgtttgcggcgctggatgtcaatgccaaaatccacgaaggggagagcggtcgccgcctgtgggcggagtgcgttgcgctgggcattgacgcgcgtaaagccattctcgcccgttgcaaactgcttcagccctttatcccactggtggttgacggcaagccgtggcaggcatatccgacggagaccattgccagcaatcgtcgtttcttcagttttgaacccggggcgaaatggcatggctttgagggctatgcggatgaccagtattttgtcgacccctgtaaactgttactgaccacgccaggtattgatgccgatagtgggcgatacaccgaattcggcatcccggcgaccattctcgcccactatctgcgtgagaacggtattgtgcctgagaagtgcgatctcaactcgattctgttcttgctgacacccgccgagagcgaagagaagctggcgcgactggtcgcgatgctggcgcaatttgaacggcacattgaagacgatacgccgcttgcggatgtattgccgacggtttttcagaaatacccggtgcgctaccgcgattacaccctgcgtgagctatgtcaggagatgcacaacctgtacgttagctttgacgttaaggatctgcaaaaagcgatgttccgcaaagaaagcctgccgcatgtggcgatgaacccacaggatgccaacagcgcctttattcgcggcgatgtagagctggtgcgtatcagcgaggcgggcgggcgtattgctgccgagggggcattgccatacccgccgggcgtactgtgcgtggtgccgggggagatttggggcggcgcggcgcagcgttattttttggcgctggaagagggcatcaatctgttgcctggtttttcgccggaattgcagggggtatatagcgagaccgatgccgatggaattcaacgcttgtacggatatgttttaaagtaa

SEQ ID NO: 343 - protein, 711 aa, Salmonella typhimurium
MKSMNIAASGELIPRLSTHRNVVALDSTDFTDVAAVVITTADSRSGILALLKRTGFHLPVFMLADEPVSAPVGVTAVIVGNAQEWLELENAACRYEAELLPPFYGTLTQYVDMGNSTFACPGHQHGEFFRKHPAGRHFYDFFGENLFRADMCNADVKLGDLLIHEGSAKHAQKFAAKVFNADKTYFVLNGTSAANKVVTNALLTRGDLVLFDRNNHKSNHHGALIQAGATPVYLEAARNPFGFIGGIDAHCFDETYLRDQIRDVMPESADASRPFRLAIIQLGTYDGTIYNARQVVDKIGHLCDYILFDSAWVGYEQFINMMADTSPLRLELNENDPGIFVTQSVHKQQAGFSQTSQIHKKDNHIRGQARFCPHKRLNNAFMLHASTSPFYPLFAALDVNAKIHEGESGRRLWAECVALGIDARKAILARCKLLQPFIPLVVDGKPWQAYPTETIASNRRFFSFEPGAKWHGFEGYADDQYFVDPCKLLLTTPGIDADSGRYTEFGIPATILAHYLRENGIVPEKCDLNSILFLLTPAESEEKLARLVAMLAQFERHIEDDTPLADVLPTVFQKYPVRYRDYTLRELCQEMHNLYVSFDVKDLQKAMFRKESLPHVAMNPQDANSAFIRGDVELVRISEAGGRIAAEGALPYPPGVLCVVPGEIWGGAAQRYFLALEEGINLLPGFSPELQGVYSETDADGIQRLYGYVLK

SEQ ID NO: 344 - DNA, 1455 bp, Clostridium perfringens
  CDS (1)..(1455)
atgaaaagactttctcaagaaaatgctcctatttatgaagcattaaaatggtacaagaatcaaagaattgttccttttgatgtaccaggtcataaacaaggaagaggaaatacagaattaagagaatttttaggtgaagattgtgtttcagtagatgtaaattcaatgaaacccttagataatctttgtcatccaacttctgtaataaaggatgcagaagaattagcagctgaggcctttggtgctgataaggcatttttcatggttaatggaaccacatcagctgtacaagccatgataatgagtgtttgcaaagatggagataagattataatgcctaggaatgtgcatagatctgcaataaattctttaataataacaggggtaactcctgtgtatataaatccaggaattcatggtagacttggaatttctctaggaatggcaatggaagatataaaaaaggccattaaggaaaatccagatgctaaggctatttttgttaataacccaacatactatgggatttgctctaatttaagagaaatagttaagttagctcatgaaaataatatgtatgtcttagttgatgaagctcatggaactcatttttattttgataaaagacttccagtatcagctatggaggcaggggcagatatggcagctgttagcatacataaaacaggaggctcattaactcagagttctatgttgcttatgaagtgtaatagaattaagccagattatgtgagaacaataataaacttaacacaaacaactagtggttcttatttacttttatcttctttagatattgctagaagaaatttagccttaaatggagaaaaaatatttgaagaggttgttggaatagctgaatatgcaagagaagaaataaataagataggtggttattacgctttctcaaaagaaataaataatggtgatgatatttatgattttgatgtaactaagcttactataaacactttagaaactggacttgctggaatagaagtttatgacatattaagagatgattatggaattcaaatagagcttggagatgtggctaatattcttgccataatatcagttggagatactagatataacattgagagattagtttcagctttaagtgagattaagagaattcatgaaaaagataaaaaagatatttttgaccacgaatatatagatcctatagttaaggttaagccaaaagaggctttttatgctgataagaagaaggttcttttaagagaaagtgaaggattaatttctggagaatttgtaatgtgttatccaccaggaattccaatacttgccccaggagagcttataactaaggagactatagactatattgagtattctaagaaaaagggaagtttagttacaggccctgaagatatggaaattgaatatataaatgttttagattgttaa

SEQ ID NO: 345 - protein, 484 aa, Clostridium perfringens
MKRLSQENAPIYEALKWYKNQRIVPFDVPGHKQGRGNTELREFLGEDCVSVDVNSMKPLDNLCHPTSVIKDAEELAAEAFGADKAFFMVNGTTSAVQAMIMSVCKDGDKIIMPRNVHRSAINSLIITGVTPVYINPGIHGRLGISLGMAMEDIKKAIKENPDAKAIFVNNPTYYGICSNLREIVKLAHENNMYVLVDEAHGTHFYFDKRLPVSAMEAGADMAAVSIHKTGGSLTQSSMLLMKCNRIKPDYVRTIINLTQTTSGSYLLLSSLDIARRNLALNGEKIFEEVVGIAEYAREEINKIGGYYAFSKEINNGDDIYDFDVTKLTINTLETGLAGIEVYDILRDDYGIQIELGDVANILAIISVGDTRYNIERLVSALSEIKRIHEKDKKDIFDHEYIDPIVKVKPKEAFYADKKKVLLRESEGLISGEFVMCYPPGIPILAPGELITKETIDYIEYSKKKGSLVTGPEDMEIEYINVLDC

SEQ ID NO: 346 - DNA, 1431 bp, Clostridium perfringens
  CDS (1)..(1431)
atgagaaatattcctataattaatggaatatcaatgtacttaagagaagaaatagtacctttttctatgccaggtcataagaatggacgaggctttaagggatttgaagaaatacttttaaaaggtgatttaactgaagttgaaggattagataatttgcagcatccagagggaataattaaagaagctgaggataaactttctaatttatataaaagtaaaaagagttattttttagttaatggaagtacttgtggaaatttaataatgatattttctttgtttaaagaaggagataaagttttagtagaaagaaactgtcacaaaagtataatgaatggaataataatgagaaaattaaaaccagtttttataaataatatatttcattcaaaattaaaagcaccagtaggaattgatttaaatcatttaaaagagcaaataagtttaaataaagatttaaaaggaataatattaacttaccctaattattatggcgtaggagttaatatagatgagactataaaaatagctagagaagcaaatttaaaagtaggaatagattcagctcatggagcacactttggatttaacaagttattgcctgaaagtgtacaagaattaaaggctgatatagttgtaatgagtgctcataaaactttaccaagtttaacacagactgcttggatgcatgttaacaatgaagattttattgaagaaatagaattttataaaaatatttttatgagtactagcccttcatatatgtttatgatgagtttagattattcaagaaactttttagaagaacatggtgaagaggcatataataacttatttaagatcatagaggattttaaaaatcatattaaggacttatcatattttaaaatattagataaggaatttttaattaatgggttagaaaaaaatattaagataaatgatattaagatagataatagtagaatagtactaaacttaagggaaaatttaaatggtaataaactattagattatttaagaagtaaaaatatacaatgtgaaatgagtgataataaaaatgttgttttaataccgtcaccatttaatactgaagaagattttaaaattttaaaagatgctttaaaatcttgtgatataaattgtcttaaagatgaagaaatagatttttatttaacagatttaccagagaaaaaattagaaccttttgaagttttggatttagaatatgaaagaattaatataaatgatgctgtaggtaaaattgtggcagagagtatagttccatacccaccaggagttcctatgataataatgggagaagtgatagaagaaagacatattaaattacttaatgagtatatgaaaagcaaggtagatttaataggtataaaggataaaaaagttaaggtaataaagaataagtaa

SEQ ID NO: 347 - protein, 476 aa, Clostridium perfringens
MRNIPIINGISMYLREEIVPFSMPGHKNGRGFKGFEEILLKGDLTEVEGLDNLQHPEGIIKEAEDKLSNLYKSKKSYFLVNGSTCGNLIMIFSLFKEGDKVLVERNCHKSIMNGIIMRKLKPVFINNIFHSKLKAPVGIDLNHLKEQISLNKDLKGIILTYPNYYGVGVNIDETIKIAREANLKVGIDSAHGAHFGFNKLLPESVQELKADIVVMSAHKTLPSLTQTAWMHVNNEDFIEEIEFYKNIFMSTSPSYMFMMSLDYSRNFLEEHGEEAYNNLFKIIEDFKNHIKDLSYFKILDKEFLINGLEKNIKINDIKIDNSRIVLNLRENLNGNKLLDYLRSKNIQCEMSDNKNVVLIPSPFNTEEDFKILKDALKSCDINCLKDEEIDFYLTDLPEKKLEPFEVLDLEYERININDAVGKIVAESIVPYPPGVPMIIMGEVIEERHIKLLNEYMKSKVDLIGIKDKKVKVIKNK

SEQ ID NO: 348 - DNA, 2280 bp, Ralstonia solanacearum Pseudomonas solanacearum
  CDS (1)..(2280)
atgaaattccgttttcccgtcatcatcatcgacgaggacttccgctccgagaacatctccgggtcgggcattcgcgcgctggcgcaggccatcgaagaagagggcatggaggtcacgggcctgaccagctatggcgacctgacctcgttcgcgcagcagtcgagccgggcgtccaccttcatcgtctcgatcgacgacgatgagttcatcaacccggacaacgacaagccggaaccggaagcggtggaaaacctgcgcagcttcgtggccgaagtgcgccgccgcaacgccaacatccccatcttcctgtacggcgagacgcgcacctcgcgccacctgcccaacgacatcctgcgcgagctgcacggcttcatccacatgttcgaggacacgccggagttcgtggcgcgccacatcatccgcgaagcccgcaactacctggattcgctgccgccgccgttcttcaaggcgctgatcgactacgcgcaggacagctcctactcgtggcactgcccggggcactcgggcggcgtggcgttcctcaagagcccggtgggccaggtgttccaccagttcttcggcgagaacatgctgcgcgccgacgtctgcaacgcggtggacgagctcggccagctgctcgaccacaccggcccggtggcggcctccgagcgcaatgccgcgcgcatcttcggctcggaccacatgttcttcgtcaccaacggcacgtccacctcgaacaagatggtgtggcacgccaacgtggcgcccggcgacatcgtggtggtggaccgcaactgccacaagtcgatcctgcacgcgatcatgatgacgggcgcgatccccgtgttcctgatgccgacgcgcaaccactacggcatcatcggcccgattccgcagagcgagttcgagcccgagaccatcgcccgcaagatcgccgagcatccgttcgccagccaggccgcgaacaagaagccgcgcatcctgaccctcacgcagggcacgtacgacggcgtgctgtacaacgccgagcgcatcaagcacatgctgtcgaccgagatcgacacgctgcacttcgacgaggcctggctgccgcacgcctcgttccacccgttctaccgcgacatgcacgccatcggccagggccgcgcgcgcagcaaggacgcgctggtgttcgccacgcagagcacgcacaagctgctggccggcctgtctcaggcttcgcagatcctcgtgcaggattccgagacgcgcaagctcgacacgtaccgcttcaacgaggcgtacctgatgcacacctcgaccagcccgcagtactcgatcatcgcctcgtgcgacgtggccgcggcgatgatggaagcgccgggcggcaccgcgctggtggaagagagcatcgccgaggccctggacttccgccgcgccatgcgcaaggtggagcaggagtacgtcggcacgaatggtggcaacggccgcggcgacgactggtggttcaaggtctggggcccgaacgacctgtccgatgaaggcatcgaggagcgcgaggcctggatgctcaaggccaacgagcgctggcacggcttcggcgacctggccgaggacttcaacctgctcgacccgatcaaggccaccatcatcaccccgggcctggacgtggacggcaagttcagcgagtcgggcatcccggcggccatcgtcacgaagtacctcgccgagcacggcatcatcgtcgagaagaccgggctgtactcgttcttcatcatgttcaccatcggcatcaccaagggccgctggaactcgatggtgaccgagctgcagcagttcaaggacgactacgacaacaaccagccgctgtggcgcgtgctgccggagttcgtgcggcagtatccgcaatacgagcgcatcggcctgcgcgagctgtgcgacgccatccacagcgtctacaaggccaacgacgtggcccgcgtgaccaccgagatgtacctctccaacatggagccggcgatgaagccgtcggacgcatgggccaagatggcgcaccgcgagaccgagcgcgtggccatcgacgacctggagggccgcatcaccgccatcctgctgacgccgtatccgccgggcattccgctgctgatcccgggcgagcgcttcaaccggaccatcgtgcagtacctgcagttcgcgcgcgagttcaacaagctgttcccgggcttcgagaccgatatccacgggctggtggaggaggagattgagggtcgggttgggtactttgtcgactgcgtgaggtaa

SEQ ID NO: 349 - protein, 759 aa, Ralstonia solanacearum Pseudomonas solanacearum
MKFRFPVIIIDEDFRSENISGSGIRALAQAIEEEGMEVTGLTSYGDLTSFAQQSSRASTFIVSIDDDEFINPDNDKPEPEAVENLRSFVAEVRRRNANIPIFLYGETRTSRHLPNDILRELHGFIHMFEDTPEFVARHIIREARNYLDSLPPPFFKALIDYAQDSSYSWHCPGHSGGVAFLKSPVGQVFHQFFGENMLRADVCNAVDELGQLLDHTGPVAASERNAARIFGSDHMFFVTNGTSTSNKMVWHANVAPGDIVVVDRNCHKSILHAIMMTGAIPVFLMPTRNHYGIIGPIPQSEFEPETIARKIAEHPFASQAANKKPRILTLTQGTYDGVLYNAERIKHMLSTEIDTLHFDEAWLPHASFHPFYRDMHAIGQGRARSKDALVFATQSTHKLLAGLSQASQILVQDSETRKLDTYRFNEAYLMHTSTSPQYSIIASCDVAAAMMEAPGGTALVEESIAEALDFRRAMRKVEQEYVGTNGGNGRGDDWWFKVWGPNDLSDEGIEEREAWMLKANERWHGFGDLAEDFNLLDPIKATIITPGLDVDGKFSESGIPAAIVTKYLAEHGIIVEKTGLYSFFIMFTIGITKGRWNSMVTELQQFKDDYDNNQPLWRVLPEFVRQYPQYERIGLRELCDAIHSVYKANDVARVTTEMYLSNMEPAMKPSDAWAKMAHRETERVAIDDLEGRITAILLTPYPPGIPLLIPGERFNRTIVQYLQFAREFNKLFPGFETDIHGLVEEEIEGRVGYFVDCVR

SEQ ID NO: 350 - DNA, 2352 bp, Fusobacterium nucleatum subsp nucleatum
  CDS (1)..(2352)
atgtctaaattagaccaaaataagacaccattatttacagtattaaaagatgaatatgtgagaagaaatatacttccatttcatgttcctggacataaaagaggaaaaggagttgatgaagaattttataacttcatgggagaggctcctttttcaatagatgtaacaatttttaaaatggttgatggtcttcatcatccaaaaagttgtattaaagaatctcaagaattagttgcagatgcttatggggttaaacatagtttctttgcagtaaatggaacttctggtgctatacaagcaatgataatgtcagttgtaaaagcaggggaaaaaatattagtaccaagaaatgttcataaatcagtttcagcaggaattattttaagtggttctgaacctgtgtatatgaatcctgaaattgatgaaaatttaggaattgctttaggtgttaaaccacaaacagttgaaaatatgttaaaacaagatccagacatagcagctgttcttattataaatccaacttattatggggtagcaacagatattaaaaagatagcagacatagttcatagctatgatatacctcttattgtagatgaagctcatggaccacatttacactttcatgatgaattaccagtttcagctgttgatgctggagcagatatctgtactcaaagtacacataaaattttaggtgctatgactcaaatgtctcttattcatgtaaattcagatagagttaatgttgaaaaagtaaaacaaattttaagtttactccatacaacttctccatcatatccattgatggcatctcttgattgtgcaagaaggcaaatagctacacaagggcaagaattgcttacaagaactattgagcttgctaaatattttagaagagaagctaatagaatacctggaatttattgttttggagaagaacttgttggaaaagatggtttctttgcttttgacccaacaaaaattacaatatctgcaaaagaactaggacttaagggtggagagcttgaaagcctacttgtagatgactacaatattcaaatggaattatcagactactataacactttagggcttattacaataggagatacagaagaaagtgtaaataaattgctagatgctttaagagatataagcagaagattttttggaaaaggaaaaacattagaaaaaaatattataaaacttcctgaaactcctgaattagtattaatgccaagagaagctttttacagtgaaaagaataaagttccatttaaagaaagtgttggaaaaatatctggtgaaatgataatggcatatccacctggtatcccaataattattgcaggagaaagaataagtcaagatataattgatcatattgaagaattaaaagaagctgatttacatattcaaggtatggaagacccagaacttgaaaccataaatgtaattgaagaagaagacgctatttacttatacactgaaaagatgaaaaatgttcttattggagtgcaaacaaatcttggagttaataaaacaggaactgaatttggaccagatgatttaattcaagcttatccagatacttttgatgaaatggaattaatttctgttgaaagacaaaaagaagacttcaatgataaaaaattaaaattcaaaaatacagttttagatacttgtgaaaagatagctaagagagttaatgaagctgtaattgatggatatagaccaatacttgttggaggagaccactcaatttcattaggaagtgtatcaggtgtttctctagaaaaagaaattggagttttatggataagtgctcatggagatatgaatacccctgaaagtacacttacaggaaatattcatggaatgccattagctttacttcaaggtctaggagatagggaacttgtaaattgtttctatgaaggagctaaacttgacagcagaaatattgttatctttggtgcaagagaaattgaagttgaagaaagaaaaattattgaaaaaactggtgtaaagattgtttattatgatgatattctaagaaaaggtatagataatgttttagacgaagtgaaagattatctaaaaattgataatttacatatcagtatagatatgaatgtatttgacccagaaattgctcctggtgtatctgtacctgttagaagaggaatgtcttatgatgaaatgtttaaatcattgaaatttgcatttaaaaattactcagttacatcagcagatattacagaatttaatccattgaatgatattaacggaaaaactgctgaacttgtaaatggtatagtacaatatatgatgaacccagattattaa

SEQ ID NO: 351 - protein, 783 aa, Fusobacterium nucleatum subsp nucleatum
MSKLDQNKTPLFTVLKDEYVRRNILPFHVPGHKRGKGVDEEFYNFMGEAPFSIDVTIFKMVDGLHHPKSCIKESQELVADAYGVKHSFFAVNGTSGAIQAMIMSVVKAGEKILVPRNVHKSVSAGIILSGSEPVYMNPEIDENLGIALGVKPQTVENMLKQDPDIAAVLIINPTYYGVATDIKKIADIVHSYDIPLIVDEAHGPHLHFHDELPVSAVDAGADICTQSTHKILGAMTQMSLIHVNSDRVNVEKVKQILSLLHTTSPSYPLMASLDCARRQIATQGQELLTRTIELAKYFRREANRIPGIYCFGEELVGKDGFFAFDPTKITISAKELGLKGGELESLLVDDYNIQMELSDYYNTLGLITIGDTEESVNKLLDALRDISRRFFGKGKTLEKNIIKLPETPELVLMPREAFYSEKNKVPFKESVGKISGEMIMAYPPGIPIIIAGERISQDIIDHIEELKEADLHIQGMEDPELETINVIEEEDAIYLYTEKMKNVLIGVQTNLGVNKTGTEFGPDDLIQAYPDTFDEMELISVERQKEDFNDKKLKFKNTVLDTCEKIAKRVNEAVIDGYRPILVGGDHSISLGSVSGVSLEKEIGVLWISAHGDMNTPESTLTGNIHGMPLALLQGLGDRELVNCFYEGAKLDSRNIVIFGAREIEVEERKIIEKTGVKIVYYDDILRKGIDNVLDEVKDYLKIDNLHISIDMNVFDPEIAPGVSVPVRRGMSYDEMFKSLKFAFKNYSVTSADITEFNPLNDINGKTAELVNGIVQYMMNPDY

SEQ ID NO: 352 - DNA, 1419 bp, Thermoanaerobacter tengcongensis
  CDS (1)..(1419)
atgtcaactcctttgtacgatgctctcatggaatacgtgaaaaaggaaactgtaccttttcacatgcccggccataaacaaggaagagtattgccaaaagagtacattgaaaatttagcaaaaattgatttgacagaggtgccaggacttgacaaccttcacaatcccgatggtccaatccttgaagctgagaagcttgcagcaaagacctttgggtcaaaacaagctttctttttggtaaatggcagtactgctggaatatatgcggccatgtatgcagtgctaaaccctacggataaagtgcttgtgatgaggaattctcataaatctgtttacaacggagttgtgcttactcaatcgattcccgtgtatttgctgcccgagatagactatgaaaatggaattgcgatgggaattgatgtagaaaggctagaggaggttttgcaaaaagaaagagatgtaaaagctgtagtagtgacataccctaattattacggtttttgcagtgatattgaaaaaattgtggatattgtgcataagtacggtaaaattttgattgtagatgaagctcatggggctcactttcctttttcaaacaatttgcctaagtcctccataaaagcaggagcggatattgtagtacagagcctgcacaagactcttacttcttttactcaaacttctatactccatttaaattctgatagggtagatgtggatcggttaaaatattctttaagcctttttcaatctacatctccttcttatattctcatgtcttcaattgacatggcaagagaatacatggagaaagaaggcaaaaaaagactagaagaagttattcaattagccctatatgtaagaagagagattgataaaatggaaggtattagatgtttaggagaagatatagttggacggtacggcattgtggattttgatgttacaaagctcactataagtgtaaagaatttgggaattgaagggcctgaagcagaggattttttgaggagagaatgcaatatacaagttgaaatgtcggatgtttacaatatattagcgatggttactgtaggggatgatgaaaaaagggtaaaaatgcttttagaaggtttaaaaaagctttcaaaaaacaggaagagggttaaatttggggatagaattctttttccttctttgcctgaaatggagttgactccttcggaagctgtgaggaaaaagaaggtgagggtaccctttgaaaaggcggaaggggcgatttctgcagattttgtgacaccttatccgccaggagttcctctcatatgtccaggagagaggattgaaaaagatatggtaaaatatatagaagtattgtataataaaggtattaaggttttgggtatacaggataatttactgtcggtgtgtgagatataa

SEQ ID NO: 353 - protein, 472 aa, Thermoanaerobacter tengcongensis
MSTPLYDALMEYVKKETVPFHMPGHKQGRVLPKEYIENLAKIDLTEVPGLDNLHNPDGPILEAEKLAAKTFGSKQAFFLVNGSTAGIYAAMYAVLNPTDKVLVMRNSHKSVYNGVVLTQSIPVYLLPEIDYENGIAMGIDVERLEEVLQKERDVKAVVVTYPNYYGFCSDIEKIVDIVHKYGKILIVDEAHGAHFPFSNNLPKSSIKAGADIVVQSLHKTLTSFTQTSILHLNSDRVDVDRLKYSLSLFQSTSPSYILMSSIDMAREYMEKEGKKRLEEVIQLALYVRREIDKMEGIRCLGEDIVGRYGIVDFDVTKLTISVKNLGIEGPEAEDFLRRECNIQVEMSDVYNILAMVTVGDDEKRVKMLLEGLKKLSKNRKRVKFGDRILFPSLPEMELTPSEAVRKKKVRVPFEKAEGAISADFVTPYPPGVPLICPGERIEKDMVKYIEVLYNKGIKVLGIQDNLLSVCEI

SEQ ID NO: 354 - DNA, 1488 bp, Thermoanaerobacter tengcongensis
  CDS (1)..(1488)
atgaaaaagctagatcaaactcaaacccctttatttgacgctctaatggaatatgtgaataataatacaattcccttccacgtaccgggacacaaaaaaggggagggaatggccaaaaaatttctagactttgttggaaaaaatgtgctctcaatggatgtaactgtgtttcagcaagtagacagcttgcacaaaccaacaggtcctatcaaatacgctcaagagttggcagcagaagcttttggagcagacgcaacatttttctcaatacacggaacctctggagccatccaagctatgattttaagcgtaatgggagaagatgaaaaaatcattgtaccaagaaacattcacaagtctgtgacctccggaatcatattaagtggcgctataccaatttacatgcagccagaaattgacaaaaatatcggggttgccttgaacgtcacccctgagacggtcgaaaaaactttaagacagcatcctgatgcaaaagcggttttaatcatcaacccaacttattacggagtttctacagacatagtaaaaattgctgaaattgtccacgattatggagcaattttaatggtagatgaagctcatggccctcaccttaaatttaacgaaaaattgcccatttcggctatggaagcaggagccgatatatgcgctcaaagcactcataaaattattggttctatgacacaaagttcaatgcttcatgtaaaaggagacaggatagatataaacagggtaaagcaggtgatgagcttattacagaccacaagcccttcatatatactcctggcgtcactggacgtagcaagaatgcaaatggctacagaaggaaaggaacttctggacaggactatcgaattagctgaatacgccagaagagagataaataaaattaaagggctttactgctttggcgaagaaatagtaggtcgcgatggcgcttatgattttgaccctacaaaagtgaccataactgccaaaggattaggtataactgggcatcaactggaaagaatcttagcagaaaaatactacattcaagtagagctttcggacatgtacaatgtcctctgcgtattctcaattggagacacaaaagaaaaagtagattacttgcttcgcgctttaagagagataagcgacgaattgtacgacgaaaacatagaagtagcaaagccaatagatattccagaaattcccgaattagtagtttcacctagatatgcctttaacgctcctacagtggctcttcctctgagagaaagtgtagggcagataagcgcagaatttttaatggcatatccacctggaataccagtgctctgccctggcgaaagaataacaatggaaattatagaatacgtcgaaaaaatgaaagaggcaaatttaagcattcaaggcacagaagacccagaggcaaattatataaaggtggtaaattacagacaggctctaaatgtaatcgcataa

SEQ ID NO: 355 - protein, 495 aa, Thermoanaerobacter tengcongensis
MKKLDQTQTPLFDALMEYVNNNTIPFHVPGHKKGEGMAKKFLDFVGKNVLSMDVTVFQQVDSLHKPTGPIKYAQELAAEAFGADATFFSIHGTSGAIQAMILSVMGEDEKIIVPRNIHKSVTSGIILSGAIPIYMQPEIDKNIGVALNVTPETVEKTLRQHPDAKAVLIINPTYYGVSTDIVKIAEIVHDYGAILMVDEAHGPHLKFNEKLPISAMEAGADICAQSTHKIIGSMTQSSMLHVKGDRIDINRVKQVMSLLQTTSPSYILLASLDVARMQMATEGKELLDRTIELAEYARREINKIKGLYCFGEEIVGRDGAYDFDPTKVTITAKGLGITGHQLERILAEKYYIQVELSDMYNVLCVFSIGDTKEKVDYLLRALREISDELYDENIEVAKPIDIPEIPELVVSPRYAFNAPTVALPLRESVGQISAEFLMAYPPGIPVLCPGERITMEIIEYVEKMKEANLSIQGTEDPEANYIKVVNYRQALNVIA

SEQ ID NO: 356 - DNA, 1479 bp, Streptomyces coelicolor
  CDS (1)..(1479)
atgacagtcgatcaccgccgagcaccggtcctggaagccctcgtcgaataccgccgtgcgggacggctgtcgttcacgccgcccggacacaagcaggcgcgcggggcggaccccgcggtgcgcgaggtgctgggtgacgccgtgttccacggggacgtgctggcgacggccggactcgacgaccggctcacccggggacgggtgctgcagcgcgcccaggagctgatggcggacgccgtgcacgccgatcacaccttcttcacgacgtgcgggagttccctgtcggtgaaggcggcgatgctggcggtggcggggccgcacgagaagctgctgatcggccgggacgcccacaagtccgtggtctcggggctgatcctgtccggcatcgagccggtgtgggtcgaaccgcgctgggacgcggaacggcatctggcccatccgccgtccgccgagtcgttcgaggaggcgttcggggcgcatcccgacgccaagggtgccctgatcaccagcccgacgccgtacggggcgagcgccgatctgcgggccgtcgccgaggtgtgccacgggcgctcgctgccgctgatcgtcgacgaggcttggggggcgcatctgcctttccacccggatctgccgtcctgggcgatggacgcgggggccgacatctgcgtgaccagcatccacaagatgggcagcggtctcgaacagggctcggtgttccacctgcgcggcgacctggtgccgcccaagctgctcggtatgcgcgccgacctgctgagcaccaccagcccgtcggtgctgatcttcgccggtctcgacgggtggcgccgccagatggcgctcggcgggcaggagctgatgggcggcgcgctggagctggcggccggtgtccgggcggccgtcgaggagatcgacggcatgcacgtcaacgaccgcgaggacttctgcggtcccgggctggcccacggcttcgatccgctgccggtcgtcatcgacctcgaagggctcggtgtctcgggcttccgggcggcggactggctgcgggagcaccgcggtgtggtcgcccacctcaccgaccaccgccgtatcggcgcgcagatcacccacggcgacgaccgggggaccgccggcgaactgctcaccgccctcaaggacctcgccctcgccgcccccggcctgggatcggctccgggcgtcgaggtgccgtcgccggccgagctgcggatgcctcaggtgtgcctgccccgggacgcgttcttcggccccaccgaggacgtgcccctggaccgggccgccggccgggtcgcggcggagatgatcactccgtatccgcccggcattccggccgtgctgccgggcgagcggctggccgagccggtcctgcgctatctgcgcagtggcctggaggcggggatgtacctccccgacccgaccgatccggcgctggagacggtcagggtcgtcgcggagcacggtgcgtaa

SEQ ID NO: 357 - protein, 492 aa, Streptomyces coelicolor
MTVDHRRAPVLEALVEYRRAGRLSFTPPGHKQARGADPAVREVLGDAVFHGDVLATAGLDDRLTRGRVLQRAQELMADAVHADHTFFTTCGSSLSVKAAMLAVAGPHEKLLIGRDAHKSVVSGLILSGIEPVWVEPRWDAERHLAHPPSAESFEEAFGAHPDAKGALITSPTPYGASADLRAVAEVCHGRSLPLIVDEAWGAHLPFHPDLPSWAMDAGADICVTSIHKMGSGLEQGSVFHLRGDLVPPKLLGMRADLLSTTSPSVLIFAGLDGWRRQMALGGQELMGGALELAAGVRAAVEEIDGMHVNDREDFCGPGLAHGFDPLPVVIDLEGLGVSGFRAADWLREHRGVVAHLTDHRRIGAQITHGDDRGTAGELLTALKDLALAAPGLGSAPGVEVPSPAELRMPQVCLPRDAFFGPTEDVPLDRAAGRVAAEMITPYPPGIPAVLPGERLAEPVLRYLRSGLEAGMYLPDPTDPALETVRVVAEHGA

SEQ ID NO: 358 - DNA, 2370 bp, Escherichia coli O6
  CDS (1)..(2370)
atgaaatttaaccacaatcttttatttatttcctcacaatatcttgatggcgacaacccttcgcagcaggtactggaagagcttcaaaccgaactcgcggaacgcggttttaaaattcatatcacgcaccagatctctgatggattaaaaatcatcgaaaaaagcccccaatacagcgggattggtttttactgggagccagacaatccgacctttgcagaagagctacagcactttatcagcatattccgcaaaagaaatgccacgacgccgctgataattttctcagaacagaatattaccgatcgtatcccactcgacgtcttaaaagaggtcagcgaatatgtttatctgttctctgaatccgcagccttcactgccaatcgactgtactccttagtccaccgctatgcggataagcttcttcctccctactttaaaacccttaaggactttaccgaggacggtgactattactgggactgcccggggcatatggggggaatggcctatctgaaacatcctgttggcattgagttcattaacttctttggcgaaaacatgatgcgcgctgatattggcgtggctaccgcggagatgggggattatctgatccacgccggaccgcctaaaaaatcggaagaaattgcggcccgactgtttggctctgattggaccttctacggtgtttccggctcatcggggtcgaaccgtattgtggcccaggctgcggttggcgcagatgaaattgccattattgaccgaaattgccacaagtcacttaatcatggcctgaccttgtctcaggcaaggccggtttacctgaaacctacccgcaacgcgtgggggctgattgggcctatcccgaccggacgcctgaagaaggccagtattgatgcgctggtggcaaacagccgactggcatctggtgcggtcagccagtccccgtcctacgccgtggtaaccaactgcacctatgatggcttctgttataacgtgaacgatgtagtcagacacctgggtgaaagcgcaccgcgcatccattttgatgaagcatggtatgcctatgcgcgtttccatccgctataccagagtcgctatgcaatggacgcggaggaaacgccaaatcgtccaaccctattcgccgtacagtccacccataaaatgctgccctcactctccatggcctcaatgattcatgtgaagaaaagcgatcgcgcgccgcttaatttcgatgactttaacgatgcctttatgatgcacggcacgacctcaccctactacccgatcattgcatcaattgatgtggcagtaagcatgatggagggtgaatccggttattcgcttgtgcaggagtcaattgaagaagcgattgccttccgtaaagccgtggtcagcgtcaagcgccagctccaggagcaggaaggtggtgacgcctggttcttcgatgtgcttcagccaaccgaagtgcaggacagcgattctgggcagcgatacagttttgaagaggcacccgtatcgctgctgagccacagcgccgactgctggtcgctgcgctccggtgagcgctggcacggttttgccgatgatgatctggtcgaaaccaacagtatgctcgatccagtaaaagtgaccctgacttgtccagggatcggcccgaagggagaataccagaaaaacggtattccgggatatttgctgacccgttttctcgatgaccgtcgcattgaaattgcccgtactggtgactacaccgtgctgatcctgttctccgtcggcatcaccaaaggcaaatggggaactctgattgaaagcctgctggcctttaaaaagcattacgacaatgacgatctggccacagatgctatcccgtcgctgaaagcgcattctccacactacgacacgctaaccctcaaggagctatgtcagataatgcatgaaaaaatggatgagctggagctgatgtcgcatatcaacgacgcggtaaacaccgatccggaaccagttatgaccccggcagaagcctatcagaaagtcgtacgctacaaaaccgagcatatccggctggatgattttagcggcagaattgccgccagcatgctcgtcccatatcccccaggcattcctgtactgatgccgggcgaacggatgccgcaaggtaacaagggcattattggctatctgcgcgccctgcaggaattcgataagcaattcccaggttttgaacatgagatccagggcgttaacgtcgatgaaaacggggacttctgggtcagagcgattgtggaagaagaacgcgatgggcagtcgctacccggccacataacctttaaacgccaggtctctggtattaaaaagggccgccagtaa

SEQ ID NO: 359 - protein, 789 aa, Escherichia coli O6
MKFNHNLLFISSQYLDGDNPSQQVLEELQTELAERGFKIHITHQISDGLKIIEKSPQYSGIGFYWEPDNPTFAEELQHFISIFRKRNATTPLIIFSEQNITDRIPLDVLKEVSEYVYLFSESAAFTANRLYSLVHRYADKLLPPYFKTLKDFTEDGDYYWDCPGHMGGMAYLKHPVGIEFINFFGENMMRADIGVATAEMGDYLIHAGPPKKSEEIAARLFGSDWTFYGVSGSSGSNRIVAQAAVGADEIAIIDRNCHKSLNHGLTLSQARPVYLKPTRNAWGLIGPIPTGRLKKASIDALVANSRLASGAVSQSPSYAVVTNCTYDGFCYNVNDVVRHLGESAPRIHFDEAWYAYARFHPLYQSRYAMDAEETPNRPTLFAVQSTHKMLPSLSMASMIHVKKSDRAPLNFDDFNDAFMMHGTTSPYYPIIASIDVAVSMMEGESGYSLVQESIEEAIAFRKAVVSVKRQLQEQEGGDAWFFDVLQPTEVQDSDSGQRYSFEEAPVSLLSHSADCWSLRSGERWHGFADDDLVETNSMLDPVKVTLTCPGIGPKGEYQKNGIPGYLLTRFLDDRRIEIARTGDYTVLILFSVGITKGKWGTLIESLLAFKKHYDNDDLATDAIPSLKAHSPHYDTLTLKELCQIMHEKMDELELMSHINDAVNTDPEPVMTPAEAYQKVVRYKTEHIRLDDFSGRIAASMLVPYPPGIPVLMPGERMPQGNKGIIGYLRALQEFDKQFPGFEHEIQGVNVDENGDFWVRAIVEEERDGQSLPGHITFKRQVSGIKKGRQ

SEQ ID NO: 360 - DNA, 1419 bp, Oceanobacillus iheyensis
  CDS (1)..(1419)
atgaagttggatcaatcttatatgccattcgtagatcatttaagaaatttcagttcaaagagaccggtatcattccatgttccagggcataagcatggggcggtttttcctgaagcagctagagaattatttggctctattttatctgtagatgtaactgaaatagcaggaatggatgacttgcatgcaccaagtgagatcatcgcagaagcagaaaaactagcaacagattatttcaattctgaccatacattttttttagttggaggatctacatcaggtaatctagcaatgattatggcagcatgtaatccgggagatgaggtaatcgtccaacggaattgtcataaatcaattatgaatggcttagaacttgcaggtgcaaagccaatatttatagctccagagtggagagatgatttacaacgatataccgcaccaacatatgatagcataaaacaagcaatgttgaggtttccgaatgcaaaggctcttattctcacctatccagattactttggggcggtttttgatattcagtccatgattgaattagcacacacctatcatattccagtatttgttgatgaagcacatggcgtccatttttcatcatctgaaatgtttccacaatcggctttacagttaggagcagatgttgtagtacaatccgcacataaaatggctccagctatgacaatggctgcatatttacatattggcacttcacgtgtagaaaaacatcgacttgcttattatttgcaaatgttacagtcgagtagtccatcttatccgataatggcttctttggatgtagcaagattttatttagcgcaattatcaaaagaaaaaatccgaggtatcttaaatagtgtagaaaacgtaagaaacatattctccggggcatcattttgggaattggtacctcatgatgatccgttaaaattaacgttccacgtgaaacatggctataaaataagtgagatagaatcgatgctcgaatatcatggaatttatccagagttaacgacagaaaatcaattcttattcatacatggtttagcgccttttgtagaacaagattatttgaaaaaaacaatacaattgatagaggaagaattaaaaaaatcagtgaaacatgctacaatagaaggggcaaagctttttaccaatcctatagaggaactagcattgtcataccaagaaatgaaacacattacatcacttcttgtcccatttgctcaaagtgaaggtgaaattgcagcagaggcagtgatcccatatccccctggtattccagtcatactcaaaggcgagagaattacgaaggcgcatattacaaagattcagcttttgattcaacaaggagtaaccattcagcaacgggaagaaggaatacgtatatataggaaggcataa

SEQ ID NO: 361 - protein, 472 aa, Oceanobacillus iheyensis
MKLDQSYMPFVDHLRNFSSKRPVSFHVPGHKHGAVFPEAARELFGSILSVDVTEIAGMDDLHAPSEIIAEAEKLATDYFNSDHTFFLVGGSTSGNLAMIMAACNPGDEVIVQRNCHKSIMNGLELAGAKPIFIAPEWRDDLQRYTAPTYDSIKQAMLRFPNAKALILTYPDYFGAVFDIQSMIELAHTYHIPVFVDEAHGVHFSSSEMFPQSALQLGADVVVQSAHKMAPAMTMAAYLHIGTSRVEKHRLAYYLQMLQSSSPSYPIMASLDVARFYLAQLSKEKIRGILNSVENVRNIFSGASFWELVPHDDPLKLTFHVKHGYKISEIESMLEYHGIYPELTTENQFLFIHGLAPFVEQDYLKKTIQLIEEELKKSVKHATIEGAKLFTNPIEELALSYQEMKHITSLLVPFAQSEGEIAAEAVIPYPPGIPVILKGERITKAHITKIQLLIQQGVTIQQREEGIRIYRKA

SEQ ID NO: 362 - DNA, 2163 bp, Shewanella oneidensis
  CDS (1)..(2163)
atgaaatcattaaaagttgccgcaagcttatctgttagatcttgttttgatatagacagagaagttgtcaatgtattaaccactgatttttgcgatgtgggtgcggctgtagtctctgttgatgatgttaaagatggtattgttgaaaaaattaaaaataccggattaaaactgcctattttcgtatcagtttgctgcgaagaaaccttcccagatgatatttgttcctcgattaccggggtatttgaactctgcggtagcaataccgatttctatggtaagcaggtcgaaaccgctatcaagaaatatgagcaagctctattaccgcccttctttggcactctgaaaaaatacgtcgaaatgggtaactccacctttgcctgcccaggccatcagggcggacaattctttcgtaaacatcccgtaggtcgccaatttttcgatttctttggcgaaaccattttccgctccgacatgtgtaatgctgacgtaaaactcggtgatctgttaatccacgaaggtgcaccactggatgcacaaaaatatgcggcaaaagtctttaacgccgataaaacctactttgtgcttaacggcacttcctcctcgaataaagtcgccaccaatgcgctgcttgctaaaggtgatttagtattattcgaccgtaataaccacaaatccaaccaccatggtgcgttaattcaagccggcgcaacaccgatttacttagaaaccgcccgtaaccccttcggctttattggcggtatcgacgcccactgcttcaaagaagcttatttaagggaacaaattcgcgaagttgcaccagaacgtgccgatgaaaaacgcccgttccgtttagcgattatccaactcggcacctacgacggcaccatctacaatgctcgccaagtggttgatcgtattggtcatctatgtgattacatcctgtttgactcggcttgggttggctatgaacagtttattcctatgatgaatgactgctcgccactgctgctggaactgacgcctgaagatcccggtattatcgtgactcaatcagtacataaacagcaggcaggtttctcacaaacgtcgcaaatccataaaaaagataaacatatcaaaggccaagcgagatattgcaaccataaacgtttcaacaatgcctttatgatgcacgcctccaccagccacttctatccactgtttgccgcattagatgtgaacgctaagatgcacgaaggtgccagcggccgttatctgtggcgtgaagccgtcaaagccgggattgaagcccgtaagttactgcttaaaaaatgtaagtatatcaagccatttatccccagcatgatcgatggccgccaatggcaggattacccaaccgagcaaatggccgatgatttgcgcttctttgaatttgaaccaggacaaaaatggcactcattcgagggctatgaaaaaggccaatatttcgttgacccttgtaagttcctattaaccacaccaggtattgatgccgaaaccggtaaatatactgagtttggtattccagcgactattttggctaacttcttacgtgaaaataatattattcccgagaagtgcgacttaaattcgatattattcctaatgacacctgcggaagatatggcaaaaatgcagcacttagtgtcgcaaatatcccgcttcgagaaattagtcgatgaagatgcgccattatcggaagtattgccaaacgtctataacgccaataaagcccgttataaagactacaccattcgccaactctgccaagaaatgcacaacctttatgtcagccatgacgtaaaacaactgcaaaaagaaatgttccgccatgctcacttcccaaccaaggtgatggacccgcaggaagccaatcttgaatttattcgtggcaatgtcgaattagtgccactgtcgcaaatcgaaggtcgaattgccgcagaaggcgccctgccatatccaccaggggtgttatgtatggtgccaggtgaaatatggggtggcgcagtacaacgttatttcttagctctcgaagaaggcatcaacttattacccggattctcccctgaattacaaggtgtttatctcgaaagcacccctgacggaaaaatccaagccttaggttatgtgttaaataaataa

SEQ ID NO: 363 - protein, 720 aa, Shewanella oneidensis
MKSLKVAASLSVRSCFDIDREVVNVLTTDFCDVGAAVVSVDDVKDGIVEKIKNTGLKLPIFVSVCCEETFPDDICSSITGVFELCGSNTDFYGKQVETAIKKYEQALLPPFFGTLKKYVEMGNSTFACPGHQGGQFFRKHPVGRQFFDFFGETIFRSDMCNADVKLGDLLIHEGAPLDAQKYAAKVFNADKTYFVLNGTSSSNKVATNALLAKGDLVLFDRNNHKSNHHGALIQAGATPIYLETARNPFGFIGGIDAHCFKEAYLREQIREVAPERADEKRPFRLAIIQLGTYDGTIYNARQVVDRIGHLCDYILFDSAWVGYEQFIPMMNDCSPLLLELTPEDPGIIVTQSVHKQQAGFSQTSQIHKKDKHIKGQARYCNHKRFNNAFMMHASTSHFYPLFAALDVNAKMHEGASGRYLWREAVKAGIEARKLLLKKCKYIKPFIPSMIDGRQWQDYPTEQMADDLRFFEFEPGQKWHSFEGYEKGQYFVDPCKFLLTTPGIDAETGKYTEFGIPATILANFLRENNIIPEKCDLNSILFLMTPAEDMAKMQHLVSQISRFEKLVDEDAPLSEVLPNVYNANKARYKDYTIRQLCQEMHNLYVSHDVKQLQKEMFRHAHFPTKVMDPQEANLEFIRGNVELVPLSQIEGRIAAEGALPYPPGVLCMVPGEIWGGAVQRYFLALEEGINLLPGFSPELQGVYLESTPDGKIQALGYVLNK

SEQ ID NO: 364 - DNA, 1314 bp, Synechococcus elongatus Thermosynechococcus elongatus
  CDS (1)..(1314)
atggagcccctgttgcgtgccctttggggaaccgccttagaacaagacctgagtgagttgcccggccttgataatttggctcaacccacaggggtgctggcagaggcacaggcggtagtggcagcgacagtggggagcgatcgcgcctggtttctcgtcaatggtgccactggtggccttttggccgcccttttggcaaccgttggtcctggcgatcgcgttctcgtcggtcgcaatgtccaccgctcagtgattgcggggctggtgttagcgggggcaaagcctgtttatttgggagttggggtggatccgcagtgggggctgccatggccagtcactcgtgatgtggttgccgctggcttggccgcctatcccgatactaaggcagtggtgcttgtcagtcccacctatgaaggcctctgctcccccttgctagagattgcccagtgtgtccataaccacggtgtgccgctcattgttgatgaagcccacggcagccattttgcctatcatcccgcctttcctgttaccgctttggccgcaggcgcggatgtggtggtgcagtcgtggcacaaaaccctcggaacgttaacccaaacggcagtgctgcatctcaagggggagcgggtgtctgctgaacgcttgagtcaggccctaaaccttgtgcaaaccagcagtcctaactactggttgctggcagcccttgagggagcaggcgttcagatggcgcagcagggagagcaaatctacgggcgacttctccagtgggtcaagacctttgaatggcctctgccgcgatggcagcccccgggcatccctcaggatccgttgcgattgaccctagggacttggccgataggtctgacggggtttgccctcgatgagcttctgcaaccgcagatcattgctgagtttcccagtgggcgatcgctaaccttttgccttggcctcggtaccacacaaacaatgctagaaaccttggccgatcgcctgaaaagtgtttacactgaatactgccacaatgccccgctgccgcccctggccatcccatcaatccccagttgccaagaaccggcactctcaccacgggaggcctacttttgcccacagcgatcaattcccctgagggcggccctcaatgagattagtgccgaaacgatcgccccctacccgcccgggattcccactgtcattgctggcgaacgattcactgaatcagtgattgcaacgttgcaaaccctccaagaactaggggcagagatggtgggggccagcgatccaacgctgcaaaccctaagaatttgcaaagtctaa

SEQ ID NO: 365 - protein, 437 aa, Synechococcus elongatus Thermosynechococcus elongatus
MEPLLRALWGTALEQDLSELPGLDNLAQPTGVLAEAQAVVAATVGSDRAWFLVNGATGGLLAALLATVGPGDRVLVGRNVHRSVIAGLVLAGAKPVYLGVGVDPQWGLPWPVTRDVVAAGLAAYPDTKAVVLVSPTYEGLCSPLLEIAQCVHNHGVPLIVDEAHGSHFAYHPAFPVTALAAGADVVVQSWHKTLGTLTQTAVLHLKGERVSAERLSQALNLVQTSSPNYWLLAALEGAGVQMAQQGEQIYGRLLQWVKTFEWPLPRWQPPGIPQDPLRLTLGTWPIGLTGFALDELLQPQIIAEFPSGRSLTFCLGLGTTQTMLETLADRLKSVYTEYCHNAPLPPLAIPSIPSCQEPALSPREAYFCPQRSIPLRAALNEISAETIAPYPPGIPTVIAGERFTESVIATLQTLQELGAEMVGASDPTLQTLRICKV

SEQ ID NO: 366 - DNA, 2181 bp, Vibrio vulnificus
  CDS (1)..(2181)
atgaagcgtttagttattggtgttagtaattacatgccagaagatttcagtttattagctgaatctttagatgaacaatttaatcgtcatcttcatcctttagagcaagtcgaattaaccgatgttggtgctgccattattacgtcggcagatattaaggctggtctacacaaagtgatttctgaaacgggttatggcattccggttttcttggtcacagatgaaaacccagtgtcagccgaagattacgtatggttaaccggcgttatcgatttagaaagacaatccatcgaatactactgtcgccaaatcaatgaagcggtaaccaaatacgaatgccgcctattgccgcctttcttcaaacaactgacgcactacgtggaaatgggcaactctgcattcgactgtccaggacaccaaggcggtcagttcttcaaaaaacacccagcaggtaaacagttctacgatttcttcggtgaaaacctattccgtagtgacttgtgtaacgcggacgtagatttaggtgacttgttaatccacgaaggctctgcccaccaagctcaagcgcacgcagcaaaagtgttcaactcagacaaaacttacttcgtactcaacggcacttcggcttcaaacaaagtggtgtgtaacgcgttagtgaccgagggggacttggtgatgtttgaccgtaacaaccacaaatcaaaccaccacggcgcattaatccaagcgggcggtatgccagtttacctagaaacggcgcgtaacccttggggctttattggtggtatggatgagcactgttttgatgaagaatacatccgtgcccaaatcgccaaagtatcacccgaacgtgcgcgtgatgaacgtccattccgtcttgcgatcatccaattgggcacttacgacggtaccatctacaacgcacgctacgtgatggataagattggtcatctgtgtgactacatcctatttgactcagcatgggtgggttacgagcagttcattccgatgatgaaagactgttctccattgctactggatctgaaaccagaagatgcgggtgtgatcgtgactcagtctgttcacaagcaacaagctggcttttctcaaacctcgcaaatccacaaaaaagaccaccacatcaaaggtcaggctcgctactgcaaccacaaacgcttcaacaacgcgtttatgatgcacgcgtcaacttcaccattctatgcgctgttctccgcattggatgtgaacgccaagatccacgatggtgaagcgggtctgcgtctatggcgtgatgcggttaagacaggtatcgaagcgcgtaaagaaatccttaagagttgtgaattgattcgtccgttcattccagaccaagtcgaaggtcaaccttggggcagctacgacactgacgtgatcgcaacgaataagaaattcttcatgtttgagccaaacgcaagctggcacaaatttgaaggttacggtgaaggtcaatacttcgttgacccatgtaaattgttgctaactactgcgggtattgcagaagacggcagctacgcagactttggtattcctgccacgctattggcgaacttcctacgtgagaacggcatcatccctgagaagtgtgacttgaactctatcttgttccttctcactccagcagaggacatgggtaagatccgtcatcttgtggcgcaaattaaccgcttcgaaaaattcattcgtgatgatgcgccgctaaacatcgtgctgcctcgcgtttacgaagcgaataaagagcgctaccgcggctacaccatccgtcagctatgtcaggaaatgcatgacatgtacaaagagctgaacgtgaaacagctacaaaaagcgatgttccgtagcgaatacttcccaactatggtgcacaaaccagatgtggcgacacgcaaatacttccgtggcgagtgtgattacttgcctctgaaagaagcggtaggtcgtgtcgcagcagaaggtgcgcttccttaccctccaggcattatctgtgtgatcacaggcgaaatctggactcaacaagtggtcgattacttcttatctctagaagaaggcatcaaccgattcccaggcttcgcacccgagattcaaggtgtgtacctagaagacgtcaatggccgcaccaccgcccattgctacgcccttaaagattaa

SEQ ID NO: 367 - protein, 726 aa, Vibrio vulnificus
MKRLVIGVSNYMPEDFSLLAESLDEQFNRHLHPLEQVELTDVGAAIITSADIKAGLHKVISETGYGIPVFLVTDENPVSAEDYVWLTGVIDLERQSIEYYCRQINEAVTKYECRLLPPFFKQLTHYVEMGNSAFDCPGHQGGQFFKKHPAGKQFYDFFGENLFRSDLCNADVDLGDLLIHEGSAHQAQAHAAKVFNSDKTYFVLNGTSASNKVVCNALVTEGDLVMFDRNNHKSNHHGALIQAGGMPVYLETARNPWGFIGGMDEHCFDEEYIRAQIAKVSPERARDERPFRLAIIQLGTYDGTIYNARYVMDKIGHLCDYILFDSAWVGYEQFIPMMKDCSPLLLDLKPEDAGVIVTQSVHKQQAGFSQTSQIHKKDHHIKGQARYCNHKRFNNAFMMHASTSPFYALFSALDVNAKIHDGEAGLRLWRDAVKTGIEARKEILKSCELIRPFIPDQVEGQPWGSYDTDVIATNKKFFMFEPNASWHKFEGYGEGQYFVDPCKLLLTTAGIAEDGSYADFGIPATLLANFLRENGIIPEKCDLNSILFLLTPAEDMGKIRHLVAQINRFEKFIRDDAPLNIVLPRVYEANKERYRGYTIRQLCQEMHDMYKELNVKQLQKAMFRSEYFPTMVHKPDVATRKYFRGECDYLPLKEAVGRVAAEGALPYPPGIICVITGEIWTQQVVDYFLSLEEGINRFPGFAPEIQGVYLEDVNGRTTAHCYALKD

SEQ ID NO: 368 - DNA, 2517 bp, Bradyrhizobium japonicum
  CDS (1)..(2517)
atgatagtcggactcgcggaagctcctcctcacccgaattgctgcgcaatccgcctctccccgcaagcggggagaggcgaaacgccagccgcagctcctgtcatccaactgtcatcgaatgtgccgagagctgtgtctccagtacattcgggacagacaatggactatttcaagcgcttcaacttcctgttcgccgcacccgtgttcgacgccgacgacctcgaaggcgtccgcttcaaccagatcatcgaggaaatccagcgctccggcttcgaggtcgtccgggcccgcaagctggaggacgcggagatcgcggtgcagaccgacgccgcgatcggctgcatggtggtggactggggcaagaagggcctggagggcaagacctcggcgctgatcaatttgatgcggcgccgcggcctcgacttcccgatcatcctgctgatccggcgcaagcggttcgaggatctgccggtcgaggtgctcgacttcatcgacggctatgtcttcctctccgaggagacgccgaccttcatcgccaagaacctgatcagccggctcaagcaatatgccgagacgctgaagacgccgttcttcggcgcgctggtcgactatgccgaggaaggcaaccagctctggacctgtccgggccacaatggcggcgtgttctacaatcgcagcccgatcggccgggtgttcgtcgagcatctcggcgaatccgtgttccgcgacgacctcgacaattccgtgctcgacctcggcgacctccttacccatgagggcccggcgctgaaggcgcagaaggaggcagcggcgatcttcggcgcggagaagacctatttcgtgctcaacggcacctcgacctcgaacaaggtcgcgctcggcgcgctcgtcaccgacggcgatctcgtgctgttcgaccgcaacaaccacaaggccgctcatcacggcgcgctgatgatcaatggcggcatcccggtctacgtcccgaccattcgcaacgcctggggcctgatcggcccgatgcgctgggacgtgctcgacgagaaggcgctgcgcgaggcgatccgcaaccatccgctggttagggatcgcgacgcctggcgcaaggaacggccgttccgcgtcgccgtggtcgaacagtgcacctatgacggctcgatccacagcgccgagatgatcctgaagcgcatcggccatctctgcgaatacatcctgttcgacgaggcctgggccggcttcatgaaattccacccgctctatgccggccgcttcgccatgggcctcgcgaaccttcccccggaagcgcccggcatcatcgcgacgcagtcgacccacaagcaactcgcgagcttctcgcaggcctcgcaaatccacatcaaggaccgtcacatccgcggccagaagcggcgcgtcgagcatcgccgcttcaacgaaagcttcatgcagcacgcttccacgtcaccgttctatccgctgttcgcatccctcgacgtcggcgcgcagatgatgaaggggcgctccggcgaagtgctgtgggacgacacgatccggctcggcatcgagctgcgcaagaagatccgcgcaatgcggcgtgagttcgaggagaaggagcagaaccccgatcggcgctggttcttcgagcccttcgtcccggatcgcgtcgccatccccgacgtcagtcgccccggcgccgcccacaatgtcgcctgggagacgctgtccaccgacgagctcgccaccaatcccgccttgtggcaactctctccggataccaactggcacggctttcccgatctcgcggaaggctttgccatgaccgatccgaacaagctgacgctgctcacgcctggcttcgatcgcaccaccggcgcctatgccgagcacggcatccccgcccccgtcgtcgcgcaatatctgcgcgagaaccgcatcgtgcccgagaagaacgacctcaactccctgctcttcctgctcactcccggcgtcgaggcgagcaaggccggcacgctgatctccggcctcgtcgccttcaagaggctgcacgacgacaatgcgttgctggcggacgcaatcccggaattctaccagcggcggcaggcgcgctatgccggcgtgcggctgcgcgatctctgcggcgacatgcaccgtttcttccgcgccgccgatgtcagcgcgctccaggcgcggcagttcatgcccgagcacatgcctgagatcgcgatgtcgccccgcgatgccgcccgctatttgttccgcaacgacgtcgactatctgccgatcgaggcgatcgcgggccgcatcgccaccacgcccttcgtagtctatccgcccggcatcgccaccatcgtgcccggcgagcggctgacggaacgcgccaagcccatggtcgattatctcaagatgttcgagacctgcttcaacacgttcccgggcttcgacgtcgaaatccagggcgtctacaaggagatcgatgcccagggccgtatcgggctctatacttacgtcgttgccgagtaa

SEQ ID NO: 369 - protein, 838 aa, Bradyrhizobium japonicum
MIVGLAEAPPHPNCCAIRLSPQAGRGETPAAAPVIQLSSNVPRAVSPVHSGQTMDYFKRFNFLFAAPVFDADDLEGVRFNQIIEEIQRSGFEVVRARKLEDAEIAVQTDAAIGCMVVDWGKKGLEGKTSALINLMRRRGLDFPIILLIRRKRFEDLPVEVLDFIDGYVFLSEETPTFIAKNLISRLKQYAETLKTPFFGALVDYAEEGNQLWTCPGHNGGVFYNRSPIGRVFVEHLGESVFRDDLDNSVLDLGDLLTHEGPALKAQKEAAAIFGAEKTYFVLNGTSTSNKVALGALVTDGDLVLFDRNNHKAAHHGALMINGGIPVYVPTIRNAWGLIGPMRWDVLDEKALREAIRNHPLVRDRDAWRKERPFRVAVVEQCTYDGSIHSAEMILKRIGHLCEYILFDEAWAGFMKFHPLYAGRFAMGLANLPPEAPGIIATQSTHKQLASFSQASQIHIKDRHIRGQKRRVEHRRFNESFMQHASTSPFYPLFASLDVGAQMMKGRSGEVLWDDTIRLGIELRKKIRAMRREFEEKEQNPDRRWFFEPFVPDRVAIPDVSRPGAAHNVAWETLSTDELATNPALWQLSPDTNWHGFPDLAEGFAMTDPNKLTLLTPGFDRTTGAYAEHGIPAPVVAQYLRENRIVPEKNDLNSLLFLLTPGVEASKAGTLISGLVAFKRLHDDNALLADAIPEFYQRRQARYAGVRLRDLCGDMHRFFRAADVSALQARQFMPEHMPEIAMSPRDAARYLFRNDVDYLPIEAIAGRIATTPFVVYPPGIATIVPGERLTERAKPMVDYLKMFETCFNTFPGFDVEIQGVYKEIDAQGRIGLYTYVVAE

SEQ ID NO: 370 - DNA, 2766 bp, Bradyrhizobium japonicum
  CDS (1)..(2766)
atggggagagacatgcccaaggacgccaagcctgcgcagcagcgcatcgatcagttcttctccgggcccggcggacgggcggacaattggcgcgatctggtcgacgcggccaaagcatggtcccgcggcggagaccgtgcgaagtatgacgctgcgctggccgatctcttcgtgacggaggaatttcacggctatcctggcctgcagctcatggcagccttgcgggaggcagccacgactggcgatgcggcaacttcgctggcgctcgccacgcggttgacgcaggccctgacgacgagatccttccgtcagcatgcgggcgactggaatacgaatgacgaaggcaacggcgagacgcccgatctggtgccgcagatgttcggtccgcacgcggcgcgccgtccctatttcgagacgctgatcgtcaccggcctcacgtccggcagttggcccgcactcgccaacgaatggcgcaagcttcggcgtccggttgatcagtttgtctacgagccggttatcgtcggcagcctcgaggacgccttctgcgccacgatcctgaacccgaacctcgcagccgtcgtcatcaacgaaggcttcgcgctacgctcacgtcacgacgcgcccgtgctccgccccctgacttcgtcggcgggattgaaggacgagtccgacgcttcggcgctgcggctcgcccatatcatcaagcacgtccgccccgagcttgacctctatctgatgtccaatcgcaacgtggaggagatggccggaaatcccgaggccgatgtcgtccgccggatcttctattcggtcgaggaactgcttgagctgcatctctcgatccttgaaggcgtgcaggatcgctacgacacgccgttcttcgacaatctgaagaaatatgcgcagcgtccgatcggaacgttccatgcgctgccgatcgcgcgcggcaaatcggtcttcaagtcggactggatccgcgacatgggcgagttctacggcctgaacctgttcctggccgaaagtagcgcaaccaccggcggcctggacagcctgttggagccgaccggcaacatcaagaaggcgcaggacaaggccgcgcgcgcgcttggcgccgatcgcgtattcttcgtgaccaatggcacctcgacgtcgaacaagatggcggtgcaggcgctgatcgggccgggcgatatcgccatcgtcgatcgcaattgccacaaatcgcatcactacgggatggtgctggccggcgcgcagccgctctatgtcgaagccttccctatgacggaatattcgatgtacggcgccgtgccgctgaagaccatcaagcaggctttgttgagcgctagggccgacggccggctcgaccgcgtcaagctgctggatctgaccaactgcactttcgacggccacatctacaatacccgccgggtgatggaggagtgccttgccatcaagcccgacctgatcttcctgtgggacgaggcctggttcggcttcgcgcgcttctcgccgttcctgcgacggcgcaccgcgatgggcgccgctagcgagatcgaagcctggatgcgcgatccgagatcggtcgcggcctacgagacgcagcaggccgagctcggcaagagtccttcggaccaggtgctgctcaagacccggctgatccccgatccacgtcagattcgccttcgcgtgtaccagaccaattcgacccacaagtcgatgtcggcgatccggcagggctcgatgctggcggtcaaggacgtcgaattccacacggtcgagcagcagttcaaggaagccgtgttcacgcacgcctccaccagtccgaaccagcagctgatcgcgagcctggatgtctcgcggcgccagatggagctggagggttacggtctcgtggccaatgcgatcgagatcgcgctggccatccgacaggcagtcaacaccaatccgctgatctcgaaatatttccgtatcctcggtgccgacgccatggtgccggcgcaatatcgccaaagcgggttcaccgattatctggcggccggcacgaactgggcgagtgcccttaagagcctggacgacgacgagttttgcctcgatccaacccgcatgacgctggtgtgcggcacagccggcttcgacggcacgcagttcaagggcatcctcgcgaacgactacaacatccaggtcaacaagacctcgcgcaattcggtgctgctccagtccaacatcaacaacacgcgcagcgacgtggcacatctcgtcagggtgctggcggagatcgccggcgaggtcgaccgtggcctgacccagggcggagccaatgcgaagagggccttcgaggcgcgggtcaagagcttgatgaccgacgtgcccgacttgccgaacttctcgcacttccaccagagcttccgcggcgacgccggcgccaagaccaacgaaggcgatatccgcagcggcttctacgcggcctatgacgcggctggttgcgaattcattcgcctcgccgaccccgagatcgaccggcgcctgaaggccggtcccgacctcgtctcagccagtttcgtgatcccgtatccgccgggcttcccgatcatggtgccgggacaggtcatcacccaggaaaccatcgacttcatgcggaagctcgatgtgaaggagatccatggctacgacgccaaggaaggcctgaagctcgtgcgggccgaggccttggcgaagatcggcaggcccaaacccggcgcgcagccgaagctgaaggccgcctcataa

SEQ ID NO: 371 - protein, 921 aa, Bradyrhizobium japonicum
MGRDMPKDAKPAQQRIDQFFSGPGGRADNWRDLVDAAKAWSRGGDRAKYDAALADLFVTEEFHGYPGLQLMAALREAATTGDAATSLALATRLTQALTTRSFRQHAGDWNTNDEGNGETPDLVPQMFGPHAARRPYFETLIVTGLTSGSWPALANEWRKLRRPVDQFVYEPVIVGSLEDAFCATILNPNLAAVVINEGFALRSRHDAPVLRPLTSSAGLKDESDASALRLAHIIKHVRPELDLYLMSNRNVEEMAGNPEADVVRRIFYSVEELLELHLSILEGVQDRYDTPFFDNLKKYAQRPIGTFHALPIARGKSVFKSDWIRDMGEFYGLNLFLAESSATTGGLDSLLEPTGNIKKAQDKAARALGADRVFFVTNGTSTSNKMAVQALIGPGDIAIVDRNCHKSHHYGMVLAGAQPLYVEAFPMTEYSMYGAVPLKTIKQALLSARADGRLDRVKLLDLTNCTFDGHIYNTRRVMEECLAIKPDLIFLWDEAWFGFARFSPFLRRRTAMGAASEIEAWMRDPRSVAAYETQQAELGKSPSDQVLLKTRLIPDPRQIRLRVYQTNSTHKSMSAIRQGSMLAVKDVEFHTVEQQFKEAVFTHASTSPNQQLIASLDVSRRQMELEGYGLVANAIEIALAIRQAVNTNPLISKYFRILGADAMVPAQYRQSGFTDYLAAGTNWASALKSLDDDEFCLDPTRMTLVCGTAGFDGTQFKGILANDYNIQVNKTSRNSVLLQSNINNTRSDVAHLVRVLAEIAGEVDRGLTQGGANAKRAFEARVKSLMTDVPDLPNFSHFHQSFRGDAGAKTNEGDIRSGFYAAYDAAGCEFIRLADPEIDRRLKAGPDLVSASFVIPYPPGFPIMVPGQVITQETIDFMRKLDVKEIHGYDAKEGLKLVRAEALAKIGRPKPGAQPKLKAAS

SEQ ID NO: 372 - DNA, 1416 bp, Clostridium tetani
  CDS (1)..(1416)
atgtcaaaattaccacttgtagaaggggtattaaattatataaaaaagaaaaatatttatttttctatgccaggtcataagcaaggtgaaggttttttatctacagatataggtaaggagataaaagaacaaattttaaaactagatatcaccgaagtaaacggtgtagacaatctgcataatcctacaggtatcataaaagaatcccaaataaaattaagtgaactttatggtagtaagaagtcttattttttagttaatggaagtagtagcggaaatatgattatgatattttcttcttttgaagaaggagacaaaataataattgatagaaattgtcataaatcaatatttaatacaattataataagaaagttaaaagctatatatgtaaagaataaaattcataaaggttttaaccttccactttctgttgatagtagccatattataaaaacaattaaagaaaataaagatgccaaaggaataattataacttatcctaattactatgggatttgttgtgatttagagaaaattattatagaagctaaaaagcacaacatgaaagtgttaattgactgtgcccatggagcacattttgttgcaaacgaaaaattacctaagaatcctgttaaactaggagcggatatggtagttatgagtagtcataaaacacttccaagtttaactcaaacagcatttttacatgttaacaatgaagaacttatagataaggtagatttttactttgatacttttataagtacaagtccttcatatttatttttagtttctatggattattctaggtattatttagaagaatatggagaagaaacttatgaaaaattaataaaattattaaagatatataaacaaaagataaattctctaaaacacctacatataatagatcaggtagatattatgtcagaatatactttagataaaagtagatatattctacacatagaagaaggttatagtgcaaatttattaatggactatcttttaaaaaataatatacaatgtgaaatgaatgatacttataatattgttataatagtatctccttttcatgtagaaaaggaaattaaatatttatatgaagttttattaaactgcgatttttctaagtttaaaattaaagaaatggacatattaaatcataatatacctaaaaaaaagctagaaccttttgaagttttgaataaaggtaaaaaaatagtagaagtagaagaatctttagattgtgtatgtgcagaaaatatagtaccatatccaccaggtattccaattattatgatgggagaaataatggatgaagaaactatagaagttataaaatattatgaagacaatggaatagaagttattggtttacatgaaaatcagatcaatgtggttaaataa

SEQ ID NO: 373 - protein, 471 aa, Clostridium tetani
MSKLPLVEGVLNYIKKKNIYFSMPGHKQGEGFLSTDIGKEIKEQILKLDITEVNGVDNLHNPTGIIKESQIKLSELYGSKKSYFLVNGSSSGNMIMIFSSFEEGDKIIIDRNCHKSIFNTIIIRKLKAIYVKNKIHKGFNLPLSVDSSHIIKTIKENKDAKGIIITYPNYYGICCDLEKIIIEAKKHNMKVLIDCAHGAHFVANEKLPKNPVKLGADMVVMSSHKTLPSLTQTAFLHVNNEELIDKVDFYFDTFISTSPSYLFLVSMDYSRYYLEEYGEETYEKLIKLLKIYKQKINSLKHLHIIDQVDIMSEYTLDKSRYILHIEEGYSANLLMDYLLKNNIQCEMNDTYNIVIIVSPFHVEKEIKYLYEVLLNCDFSKFKIKEMDILNHNIPKKKLEPFEVLNKGKKIVEVEESLDCVCAENIVPYPPGIPIIMMGEIMDEETIEVIKYYEDNGIEVIGLHENQINVVK

SEQ ID NO: 374 - DNA, 1464 bp, Clostridium tetani
  CDS (1)..(1464)
atgctgtacagattaaatcaatcagaaactccattatttgatgcgttaatggaatatgtgaatagacaaactataccttttcacgttcctggtcataaaaaaggagtaggaatagatgaggaatttaaaaattttataggtgagaatccttttaaaatcgatgttactgtttttaaactagtggatagcttacatcatcctacaggtcctataaaaaaagctcaagcattagcttctgatgcatatggctctgatgcttcatttttttgtattcatggtacctctggtgctatacaggcaatgataatgtctgtggtgaaatctggtgataaaataattatcccaagaaatgtccataaatcagtaacttctggcattatattaagtggggctacccccatttatatgcaaccagaattagataaaagagttggtatcgctcatggcgttactcctgaaactgtagaaaaaacattaaaagaaaatcctgacgctaaagcagttttaataattaatccaacttattatggcgttgctactgatattaagaaaatagcagatatagttcataattatgatattcctttaattgtagatgaagctcatggtcctcatttagcttttaacgatacacttccaatatcagctattgaagctggtgctgatatttgttgccaaagtacacataaaataataggtgctctaactcaatgttcattacttcacgttcgttctaaaagtatagatgtaaatagagttcagcaaatgttaagtttacttcaaactacatctccttcatatatattaatggcttcacttgactgtgctagaagacaaatagctttaaatggtaaggaattattagataaatccatagctttatctaactatgcccgtgaagaaataaataaaattcctggcttctattgtttcggtaaagaaattgttggaagacctggtgtttttgctatagatcctactaaaataactataacctgtagagatttaggtattactggttttgaattagatatgattttatctaaccaatatcacattcaactagaattatcagatttatataatggtcttgctgtaggctcctttggagatacaaaggaaaatatagatgcactaattaatgcactaaaagaaataagtaaagagtatgtaaataatgagaataaaaaatctgactttatagatataccagctataccaaagcaagttcaaattcctagagatgcttttaatagtgaaaaagtagttcttcctttaaaagatagtgaaggaagagttagtggggaatttttaatggcttatcctcctggaatacctgtactttgccctggggaaataattactcaagaaataattgattatatacaaaaattaaaagatactggtctttatgtacaaggtacagaagatttagaagtgaattttataaaagttgtaaaataa

SEQ ID NO: 375 - protein, 487 aa, Clostridium tetani
MLYRLNQSETPLFDALMEYVNRQTIPFHVPGHKKGVGIDEEFKNFIGENPFKIDVTVFKLVDSLHHPTGPIKKAQALASDAYGSDASFFCIHGTSGAIQAMIMSVVKSGDKIIIPRNVHKSVTSGIILSGATPIYMQPELDKRVGIAHGVTPETVEKTLKENPDAKAVLIINPTYYGVATDIKKIADIVHNYDIPLIVDEAHGPHLAFNDTLPISAIEAGADICCQSTHKIIGALTQCSLLHVRSKSIDVNRVQQMLSLLQTTSPSYILMASLDCARRQIALNGKELLDKSIALSNYAREEINKIPGFYCFGKEIVGRPGVFAIDPTKITITCRDLGITGFELDMILSNQYHIQLELSDLYNGLAVGSFGDTKENIDALINALKEISKEYVNNENKKSDFIDIPAIPKQVQIPRDAFNSEKVVLPLKDSEGRVSGEFLMAYPPGIPVLCPGEIITQEIIDYIQKLKDTGLYVQGTEDLEVNFIKVVK

SEQ ID NO: 376 - DNA, 1422 bp, Bacillus anthracis strain Ames
  CDS (1)..(1422)
atgaatcaaaatcgcatacctttatatgaagcattaatagagtttaaagaaagaagacggttatcctttcatgttccaggtcataaaaatggtttaaacttccctcaggaggtagtagaggagtttaaagatatactatctatcgatgtaactgagttgtcaggattagatgatttacatagtccgtttgaatgtatagatgaggcacaacaattattagctgatgtatatggagtgaacaaaagttattttttaattaatggttcaacagtcgggaatctagcaatgattttgtcttgttgtggggaacatgatattgttcttgtacaaagaaattgtcataaatcgattattaatggtttaaaattagcgggagcaaatcctatttttttagatccatggattgatgaagcttataacgtaccagtgggaattcatgatgagattattaaggaagcgattgaaaaatacccaaatgcgaaagcgctcattttaacgcatcctaattattatggtatggggatggatctagaggcaagcattgcttatgcacatacacataaaatccctgtgctagtagatgaagcacatggggctcatttttgtttaggcggggcatttccacagtcagcgttagcatatggtgcagatatggtagttcattctgcgcataaaacattacccgcgatgacgatgggatcctatttacatataaatagtcgtttagtgaaagaagaaaaagtttctacttatttaagtatgctacaatctagtagtccatcgtatccaattatggcttctcttgatattgcacgctttacaatagcacgtataaaagaaaagggacatgatgaaattgtcgagtttttacaggaatttaaagaagaattgagtactattccacaaatagctattttacaatatccattacaagacgggctaaagattaccgtacagacgcgttgtcggttatcaggatacgaattacagtctgtatttgaaaaggtcggtatatatacagaaatggcagatccatataatgtcttatttattttgcctttgcaagtaaataagaaatatatgaaggctatagagatgatccgagtagcattgcaatactatgaggtgaaagacaagacggaatctattcgttatacttataaaggagaaatttctcccctgccgtatacatataaacaactggaagaatacgaaacaaaagtagtacctatagaagaagcagttgggatggtagcagcggaaatggtaattccgtatccacctggtattccattgattatgtatggagaaagaattacttcaggacataaagaacaaattatgtatttagaaaaagcaggtgctcgttttcaaggtagcaggaaatatatgaaagtgtatgatatagaaagtaggttttaa

SEQ ID NO: 377 - protein, 473 aa, Bacillus anthracis strain Ames
MNQNRIPLYEALIEFKERRRLSFHVPGHKNGLNFPQEVVEEFKDILSIDVTELSGLDDLHSPFECIDEAQQLLADVYGVNKSYFLINGSTVGNLAMILSCCGEHDIVLVQRNCHKSIINGLKLAGANPIFLDPWIDEAYNVPVGIHDEIIKEAIEKYPNAKALILTHPNYYGMGMDLEASIAYAHTHKIPVLVDEAHGAHFCLGGAFPQSALAYGADMVVHSAHKTLPAMTMGSYLHINSRLVKEEKVSTYLSMLQSSSPSYPIMASLDIARFTIARIKEKGHDEIVEFLQEFKEELSTIPQIAILQYPLQDGLKITVQTRCRLSGYELQSVFEKVGIYTEMADPYNVLFILPLQVNKKYMKAIEMIRVALQYYEVKDKTESIRYTYKGEISPLPYTYKQLEEYETKVVPIEEAVGMVAAEMVIPYPPGIPLIMYGERITSGHKEQIMYLEKAGARFQGSRKYMKVYDIESRF

SEQ ID NO: 378 - DNA, 1482 bp, Not available
  CDS (1)..(1482)
atgtatagattgtcccaatacgaaacaccattgtttaccgctttagttgagcacagtaagcgaaatccaattcaattccatattccaggtcataaaaaagggcaaggcatggatcctgaatttcgcgaatttattgggcataatgcattagcaattgatttaattaacattgcgccgctcgatgatttacatcatccaaaaggtatgattaaagaagcacaagatttagcagccgctgcatttggtgcggatcatactttcttttctattcaaggtacaagtggcgcaataatgacaatggtgatgagcgtttgcggtcctggtgacaaaatactagtgccacgaaacgtgcataaatcagtaatgtcagctattattttctcaggtgcaaaacctattttcatgcatcctgaaatcgatccaaaacttggtatttcacatggaatcacaatccaatctgtcaaaaaagcacttgaagagcactcagatgcgaaaggcttacttgttattaatccaacatactttggctttgctgcggacttagaacagattgtacaattagcacattcttacgatatccctgtactcgttgatgaggctcatggtgttcatattcattttcacgatgaactgccgatgtcagcgatgcaagccggtgcagatatggcagcaacgagtgttcacaaattaggtggatctttaacgcaaagctctattcttaatgtaaaagaaggccttgtgaacgtaaaacatgttcaatctattattagcatgcttacgactacatcaacgtcttacatcttgttagcctccctagatgttgctagaaaacgtcttgctacagaaggaaaggcgctcatagaacaaacaatacaattagcggaacaagttcgtaatgctataaatgatattgaacatctttactgtccagggaaagaaatgctaggtacggatgctacttttaactatgatcctacaaagataattgtatctgtaaaagatttaggtattacaggccatcaggctgaagtatggcttagagagcaatataacattgaagtagaactctcagatttatacaacatactatgtcttgtcacttttggagatacagaaagtgagacgaatacacttattgcagcattacaagatttatcagcaatatttaaaaataaagctgataaaggtgttcgaatacaagtagaaattccagaaatacctgtgttagcactttctcctcgagatgctttttattcggaaacagaagtcatcccatttgaaaatgcagcaggtcgtattatagctgatttcgttatggtttatccgccagggattccaatctttactccgggggaaattattacacaagacaacttagagtatattcgtaaaaacttagaagcaggtttacctgtacaaggtcctgaagatatgacattacaaacattacgcgtgatcaaagagtacaagcctatcagttga

SEQ ID NO: 379 - protein, 493 aa, Not available
MYRLSQYETPLFTALVEHSKRNPIQFHIPGHKKGQGMDPEFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGKALIEQTIQLAEQVRNAINDIEHLYCPGKEMLGTDATFNYDPTKIIVSVKDLGITGHQAEVWLREQYNIEVELSDLYNILCLVTFGDTESETNTLIAALQDLSAIFKNKADKGVRIQVEIPEIPVLALSPRDAFYSETEVIPFENAAGRIIADFVMVYPPGIPIFTPGEIITQDNLEYIRKNLEAGLPVQGPEDMTLQTLRVIKEYKPIS

SEQ ID NO: 380 - DNA, 1422 bp, Bacillus cereus strain ATCC 14579 DSM 31
  CDS (1)..(1422)
atgaatcaaaatcgtatgcctttatatgaggcgttaatagagtttaaagaaagagggccgttatcctttcatgttcctggtcataagaatggtttaaacttccctcaggaggcaataagagagtttaaaggtattctatctattgatgtaactgaattagcaggactagatgatttgcatagtccgtttgaatgtatagatgaggcacaacaattattggctgaagtttataatacaaagagaagttattttttaattaatggttcaacagtcgggaacttagcaatgattttgtcttgttgcggggaacatgatattgttcttgtacaaagaaattgtcataaatcaattattaatggtttaaaacttgcgggagcaaatcccatttttttagatccatggattgatgaagcttataacgtaccagtgggagttcgtaatgaaattattaagaacgcaattggaaagtatccaaatgcgaaagcacttattttaacgcatcctaattattatggtatggggatggatttagaggcaagcatcgcttttgcacatgcacataaaatccctgttttggtagatgaggcacatggggcacatctatgtttgggagaaccatttccgaagtcagcattaacatatggtgcagatattgtagttcattctgcacataaaacattacccgcaatgacaatgggttcctatttacatataaatagtcatttagtagacgaagataaggttactacttatttaagtatgctacaatctagtagtccatcgtatccaattatggcttccttggatatagcacgctttacaatggcgcgtataaaagaagaaggtcacagtgaaattgttgagtttttacgaagatttaaggaacaattacgttctattccccaaatcgccattttagaatatccgttgcaagatgagttaaaggtcaccgtacaaactcgttgtcagttatcagggtacgaattacagtctgtatttgaaaaggtcggtatatatacagagatggctgatccgtacaatgtcctatttattttacccttacaagtaaatgagggatatatgaaggttatagagatgatccgagtagcattgcaacattatgaggtgaaagacaagagggaatctattcgttatacttataatggtgaattctctcttttaccgtatacgtataaacaactagacggatatgaaacaaagatagtatctatagaagaggctgttggaatgatagcggcggaaatggtgattccgtatccacctggaattccattaattatgtatggagagagaattacttcagagcataaagagcaaattatgtatttagaaagagcaggagctcgttttcaaggtaatacgaaatatatgaaagtgtatgatatagaaagtaggttttaa

SEQ ID NO: 381 - protein, 473 aa, Bacillus cereus strain ATCC 14579 DSM 31
MNQNRMPLYEALIEFKERGPLSFHVPGHKNGLNFPQEAIREFKGILSIDVTELAGLDDLHSPFECIDEAQQLLAEVYNTKRSYFLINGSTVGNLAMILSCCGEHDIVLVQRNCHKSIINGLKLAGANPIFLDPWIDEAYNVPVGVRNEIIKNAIGKYPNAKALILTHPNYYGMGMDLEASIAFAHAHKIPVLVDEAHGAHLCLGEPFPKSALTYGADIVVHSAHKTLPAMTMGSYLHINSHLVDEDKVTTYLSMLQSSSPSYPIMASLDIARFTMARIKEEGHSEIVEFLRRFKEQLRSIPQIAILEYPLQDELKVTVQTRCQLSGYELQSVFEKVGIYTEMADPYNVLFILPLQVNEGYMKVIEMIRVALQHYEVKDKRESIRYTYNGEFSLLPYTYKQLDGYETKIVSIEEAVGMIAAEMVIPYPPGIPLIMYGERITSEHKEQIMYLERAGARFQGNTKYMKVYDIESRF

SEQ ID NO: 382 - DNA, 1383 bp, Not available
  CDS (1)..(1383)
atgtcccaatacgaaacaccattgtttaccgctttagttgagcacagtaagcgaaatccaattcaattccatattcctggtcataaaaaaggacagggcatggatcctacatttcgcgaatttattgggcataatgcattagcaattgatttaattaatattgcgccactcgatgatttacatcatccaaaaggtatgattaaagaagcacaagatttagcagcagccgcattcggtgcagatcatactttcttttctattcaaggtacaagtggcgctattatgacaatggtgatgagcgtttgcggtcctggtgacaaaatcctagtaccacgaaacgtgcataaatcagtaatgtcagctattattttctcaggtgcaaaaccgattttcatgcatcctgaaatcgatccgaagctcggtatttctcatggaatcacaattcaatctgtaaaaaaagcacttgaagagcactcagatgcaaagggcttacttgttattaacccaacgtactttgggtttgctgcagacttagaacagattgtacaattagcacattcttatgacatccctgtactagtcgacgaagctcatggtgttcatattcattttcacgatgaattacctatgtcagcgatgcaagctggtgcggatatggcagcaacaagtgttcacaaattaggaggctctttaactcaaagttctattcttaatgtgaaagaaggcttagtgaatgtaaagcatgtccaatctattattagcatgcttacaaccacatcaacttcttacatcttgttagcatcccttgatgttgcgagaaaacgtcttgctacagaaggaacagcactcatagaacaaacaatacaattagctgagcatgttcgtgatgctataaattctattgagcatctttactgtcctggaaaagaaatgttaggtacagatgctacctttaactatgatcctacaaagataattgtatctgtaaaagatttaggtattaccggccaccaagctgaagtatggcttagagagcaatataacattgaagtagaactctcagatctatacaacatactatgtcttatcactttgggagatacagaaagtgatacaaatacacttattgcagcattacaagatttagcagcaacatttagaaatagggcagataaaggtgttcaagtacaagtagagattccagaaattccagtgctagcactttctcctcgagatgctttttattcggaaacagaagtcattccatttgaaaatgcagcggggcgtattatagctgattttgttatggtttatccgccagggattccaatctttactccggggggaaattattacacaagaaaacttagagtatattcgtaa

SEQ ID NO: 383 - protein, 460 aa, Not available
MSQYETPLFTALVEHSKRNPIQFHIPGHKKGQGMDPTFREFIGHNALAIDLINIAPLDDLHHPKGMIKEAQDLAAAAFGADHTFFSIQGTSGAIMTMVMSVCGPGDKILVPRNVHKSVMSAIIFSGAKPIFMHPEIDPKLGISHGITIQSVKKALEEHSDAKGLLVINPTYFGFAADLEQIVQLAHSYDIPVLVDEAHGVHIHFHDELPMSAMQAGADMAATSVHKLGGSLTQSSILNVKEGLVNVKHVQSIISMLTTTSTSYILLASLDVARKRLATEGTALIEQTIQLAEHVRDAINSIEHLYCPGKEMLGTDATFNYDPTKIIVSVKDLGITGHQAEVWLREQYNIEVELSDLYNILCLITLGDTESDTNTLIAALQDLAATFRNRADKGVQVQVEIPEIPVLALSPRDAFYSETEVIPFENAAGRIIADFVMVYPPGIPIFTPGGNYYTRKLRVYS

SEQ ID NO: 384 - DNA, 2142 bp, Shigella flexneri
  CDS (1)..(2142)
atgaacatcattgccattatgggaccgcatggcgtcttttataaagatgagcccatcaaagaactggagtcggcgctggtggcgcaaggctttcagattatctggccacaaaacagcgttgatttgctgaaatttatcgaacataaccctcgaatttgcggcgtgatttttgactgggatgagtacagtctcgatttatgcagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaatacccttaaggctgatgtctctatttcggtcaccgagcttggttcgttgcttgaccacaccgggccacacctggaagcggaagagtacatcgcgcggacttttggcgcggaacagagttatatcgttaccaacggaatatcgacgtcgaacaaaattgtgggtatgtacgccgcgccatccggcagtacgctgttgatcgaccgcaactgccataaatcactggcgcatctgttgatgatgaacgatgtagtgccagtctggctgaaaccgacgcgtaatgcgttggggattctgggggggatcccgcgccgtgaatttactcgcgacagcatcgaagagaaagtcgctgccactacgcaagcacaatggccggttcatgcggtgatcaccaactccacctatgatggtttgctctacaacaccgactggatcaaacagacgctggatgtcccgtcgatccacttcgattccgcctgggtgccgtatactcattttcatccaatctaccagggtaaaagtggtatgagcggcgagcgtgttgcgggaaaagttttcttcgaaacgcaatcgacccacaaaatgctggcggcgttatcgcaggcttcactgatccacattaaaggcgagtatgacgaagaggcgtttaacgaagcctttatgatgcataccaccacctcgcccagttatcccattgttgcttcggttaagacggcggcggcgatgctgcgtggtaatccgggcaaacggctgattaaccgttcggtggagcgggcgctgcattttcgcaaagaggtccagcggctgcgggaagagtctgacggttggtttttcgatatctggcaaccgccgcaggtggatgaagccgaatgcaggcccgttgcgcctggcgaacaatggcacggctttaacgatgcggatgccgatcatatgtttctcgatccggttaaagtcactattttgacaccggggatggacgaacagggcaatatgagtgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgctgaagatcccgatttctaccgcaatatgcgtattcaggatctggcgcaagggatccataagctgattcgtaaacacgatctttccggtttgatgttgcgggcattcgatactttgccggaaatgatcatgacgccacatcaggcatggcagagacagattaaaggtgaagtagaaaccattgcgctggaacaactggtcggtagagtatcggcaaatatgatcctgccttatccaccgggcgtaccgctgttgatgccaggagaaatgctgaccaaagagagccgcacggtactcgattttctactgatgctttgttccgtagggcaacattaccccggttttgaaacggatattcacggcgcgaaacaggacgaagacggcgtttaccgcgtacgagtcctaaaaatggcgggataa

SEQ ID NO: 385 - protein, 713 aa, Shigella flexneri
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTNEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGISTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVFFETQSTHKMLAALSQASLIHIKGEYDEEAFNEAFMMHTTTSPSYPIVASVKTAAAMLRGNPGKRLINRSVERALHFRKEVQRLREESDGWFFDIWQPPQVDEAECRPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLSGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 386 - DNA, 2271 bp, Bordetella parapertussis
  CDS (1)..(2271)
atgaaattccgcttccccattttcatcatcgacgaagactatcgctccgagaacgcctcggggttgggcattcgcgcgctggcttcggcgatcgaggccgagggcgtggaggtcatcggggtgaccagctacggcgacctgagctcgtttgcccagcagcaaagccgcgccagcgccttcatcctgtcgatcgacgatgaggagttcgacgtcgattctccggaagacgtggcgggcgcgatcaagaacctgcgcacgttcatcggcgagctgcgtttccgcaacgccgacatccccatctacctgtacggcgagacgcgcacgtcggaacacatcccgaacgacatcctgcgcgagctgcacggcttcatccacatgttcgaggacacgccggagttcgtggcgcgccacatcatccgcgaagcgcgcagctacgtggacggcctgctgccgccgttcttccgcgagttggtcaaatatgcccaggacggttcgtattcctggcactgcccggggcactcgggcggcgtggcgttcctcaagagcccggtgggccagatgttccaccagttcttcggcgagaacatgctgcgcgccgacgtctgcaacgcggtcgacgaactgggccagctgctggaccacaccggcccggtggccgagtccgagctgaatgccgcgcgcattttccatgccgaccactgcttcttcgtcaccaacggcacctcgacgtcgaacaaggtcgtctggcatgccaacgtggccgccggcgacgtggtggtggtggaccgcaactgccacaagtcgatcctgcacgccatcacgatgaccggcgcgatcccggtgttcctgcgccccacgcgcaaccacctgggcatcatcggtccgatcccgctcgacgaattcgacccggagaacatccgccgcaagatcgaggccaacccgttcgcgcgcgaggcgctgaacaagaagccgcgcatcctcacgctgacgcagagcacctatgacggcgtcatctacaacgtcgagatgatcaaggaaaagctgggcacctacgtcgacacgctgcatttcgacgaggcctggctgccgcacgcggccttccacgagtactaccgcgacatgcacgcgatcggcccggaccgcccgcgcagccaggacgccatggtgttcgccacgcactccacgcacaagctgctggccggcatctcgcaggcctcgcagatcatcgtgcaggagtccgagagccgcaagctggaccgcaacctcttcaacgaggcctacctgatgcatacgtcgacctcgccgcagtacgcgatcatcgcgtcgtgcgacgtggccgccgccatgatggagccgccgggcggcaccgccctggtcgaggaaagcatccgcgaggccatggactttcgccgcgccatgcgcaaggtggcctccgagttcggcaaggacgactggtggtttaaggtgtggggccccaaccgcctcgcgcccgagggcatcggccatcgcgacgactgggtgctggagtcgggcgaccactggcacggctttggcgacctggcgccgggcttcaacatgctcgacccgatcaaggccaccatcatcaccccgggcctggacatgtcgggcagcttcggcgaaagcggcataccggccgcgctggtgtcgaagtacctggccgagcacggcgtcgtggtggagaagaccggcctgtattcgttcttcatcctgttcaccatcggtatcaccaagggccgctggaacaccctgctgaccgcgctgcagcagttcaaggacgactacgaccgcaaccagcccctgtggcgtatcctgcccgagttctgccgcggtcaccgccgctacgagcgcatgggcctgcgcgacctgtgccagcagatccacgaggcctatcgcgaacgcgacgtggcgcgcctgaccaccgagatgtacctgagcgacatggtgccggcgctcaagccctcggacgccttcgcccgcatggcgcaccgcgaagtcgagcgcgtcgagatcgaccagctcgaaggccgcgtgaccggcgtgctgctcacgccgtacccgccgggcattccgctgctgatcccgggcgagcgcttcaaccggaccatcgtgcaatacctgcagttcgcgcgcgagttcaacgagcgcttccccggcttcgagacctacatccacggcctggccgacgaagagggccccgatggcgccaagcgctattacgtcgactgcctgaaggacgccggcgagcagtaa

SEQ ID NO: 387 - protein, 756 aa, Bordetella parapertussis
MKFRFPIFIIDEDYRSENASGLGIRALASAIEAEGVEVIGVTSYGDLSSFAQQQSRASAFILSIDDEEFDVDSPEDVAGAIKNLRTFIGELRFRNADIPIYLYGETRTSEHIPNDILRELHGFIHMFEDTPEFVARHIIREARSYVDGLLPPFFRELVKYAQDGSYSWHCPGHSGGVAFLKSPVGQMFHQFFGENMLRADVCNAVDELGQLLDHTGPVAESELNAARIFHADHCFFVTNGTSTSNKVVWHANVAAGDVVVVDRNCHKSILHAITMTGAIPVFLRPTRNHLGIIGPIPLDEFDPENIRRKIEANPFAREALNKKPRILTLTQSTYDGVIYNVEMIKEKLGTYVDTLHFDEAWLPHAAFHEYYRDMHAIGPDRPRSQDAMVFATHSTHKLLAGISQASQIIVQESESRKLDRNLFNEAYLMHTSTSPQYAIIASCDVAAAMMEPPGGTALVEESIREAMDFRRAMRKVASEFGKDDWWFKVWGPNRLAPEGIGHRDDWVLESGDHWHGFGDLAPGFNMLDPIKATIITPGLDMSGSFGESGIPAALVSKYLAEHGVVVEKTGLYSFFILFTIGITKGRWNTLLTALQQFKDDYDRNQPLWRILPEFCRGHRRYERMGLRDLCQQIHEAYRERDVARLTTEMYLSDMVPALKPSDAFARMAHREVERVEIDQLEGRVTGVLLTPYPPGIPLLIPGERFNRTIVQYLQFAREFNERFPGFETYIHGLADEEGPDGAKRYYVDCLKDAGEQ

SEQ ID NO: 388 - DNA, 1401 bp, Prochlorococcus marinus strain MIT 9313
  CDS (1)..(1401)
atgggctttcttcccctgttgactcgcgaccgtggtcgcaggttgcatcttcccgctcatggtcgtggggctggcttgcctgatgatctgcgtgcaatgttgcgccatcgagctggcatctgggatctgccggaacttcctgagttgggtgggccattgatgcagcagggggcggtggcagagagtcaaaggcaggcagcgattgctatcggggctgagcggggttggtatggcgtcaatggcgcgacaggcctcttgcaggctgctctcttggcaatagcaaggcctggtcaggctgtgttgatgcctcgcaatgtccatcgcagtctcattcaggcttgtgttttgggcgatctcacgcctgtcttgtttgacctgcctttcatggttgatcggggtcatgtgcttccccctgatggaccttggttgaaggacgttttgaatgaacttcctatcgctggtgttgagatcgctgcagctgtgttggtgcatcccacttatcagggctatgcgacagatctcaagcccatggttgttgagcttcattctcggggttggccggtattagtggatgaggctcatggtgctcatttcgccagtcgggtggatgcatctttacctgattctgcgatcacagcaggtgctgacttaatcgttcactcattgcacaaatctgctgccggtttgactcagacggcagtgctttggagtcaaggggatcgcgttgatcccaaagctgtcgagcgcagtctcggctggttgcaaactaccagtccaagcgcactcttgctggcttcttgtgaagcgtcgctgagtgacttgtgcaagcctgcaggcttgcacaagctgggaacgcgcctcaaggatgctcgcgaattggcggttcaacttcgtcagttgggattgcctttgcttgaaaaccaggatcccttgcggctgattttgcacaccgctgcagagggtatcagcggacttgaagcagatgcttggctgatggccagggggctggtgggcgaacttccagaaccaggctgcctaacgttctgtcttggcttggcgcctcagcgtggattggtcaggttgatgcatcgtcgctggcggggactccttgcggcccaaggtaagggcctacctttgccagtctttacgcccccgccactgccgcgcatcacagcaccagcaatggcttgtggcttggcttggcgcgctcaaagtcggagagtgtcgattgctgatgcggtagggagagtcgcggcggagttaatctgtccctatcctccagggattcccttgctagtgccgggtgagaagctggatcacagacgtgtggactggcttttagagcagcagaacctttggcccgatcagatcgctggtacggtaaaagttatggccttgtaa

SEQ ID NO: 389 - protein, 466 aa, Prochlorococcus marinus strain MIT 9313
MGFLPLLTRDRGRRLHLPAHGRGAGLPDDLRAMLRHRAGIWDLPELPELGGPLMQQGAVAESQRQAAIAIGAERGWYGVNGATGLLQAALLAIARPGQAVLMPRNVHRSLIQACVLGDLTPVLFDLPFMVDRGHVLPPDGPWLKDVLNELPIAGVEIAAAVLVHPTYQGYATDLKPMVVELHSRGWPVLVDEAHGAHFASRVDASLPDSAITAGADLIVHSLHKSAAGLTQTAVLWSQGDRVDPKAVERSLGWLQTTSPSALLLASCEASLSDLCKPAGLHKLGTRLKDARELAVQLRQLGLPLLENQDPLRLILHTAAEGISGLEADAWLMARGLVGELPEPGCLTFCLGLAPQRGLVRLMHRRWRGLLAAQGKGLPLPVFTPPPLPRITAPAMACGLAWRAQSRRVSIADAVGRVAAELICPYPPGIPLLVPGEKLDHRRVDWLLEQQNLWPDQIAGTVKVMAL

SEQ ID NO: 390 - DNA, 2196 bp, Shigella flexneri
  CDS (1)..(2196)
atggggcagggttttccaccttgtccggtattcttacttccccgaaacgggtttgcgcttatgaaatcaatgaatattgccgccagtagtgaactggtatcccgactttcttctcatcgccgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttctttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcggggacgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctgacgattattcagctgggaacctatgacggcactgtctataacgcccgtcaggtgatcgataccattgggcatctgtgtgattacattctgtttgattccgcgtgggtcggttacgaacagtttatctcgatgatggcggatagctcgccgctgctgttagaacttaacgaaaacgatccggggatttttgtgacccagttggtgcacaaacagcaggctggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcaatgccgaaaccggcgaatatagcgactttggcgttccggcgacgattctggcgcactatctgcgtgagaacggcattgtgccggagaagtgcgatctcaactccattctgttcttattaactccggcggaaagccacgagaagctggcacaactggtggcgatgctggcgcaatttgaacagcatattgaggatgactcgtcgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacgattgtacggttatgtgttgaagtaa

SEQ ID NO: 391 - protein, 731 aa, Shigella flexneri
MGQGFPPCPVFLLPRNGFALMKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGTTPVYLEASRNPFGFIGGIDAHCFNEEYLRQQIRDVAPEKADLPRPFRLTIIQLGTYDGTVYNARQVIDTIGHLCDYILFDSAWVGYEQFISMMADSSPLLLELNENDPGIFVTQLVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGAKWHGFEGYAADQYFVDPCKLLLTTPGINAETGEYSDFGVPATILAHYLRENGIVPEKCDLNSILFLLTPAESHEKLAQLVAMLAQFEQHIEDDSSLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 392 - DNA, 1251 bp, Chromobacterium violaceum
  CDS (1)..(1251)
atgatcttccagaccctgctggcgccgggcgacaagctgctgctggatcgcaactgtcacaaatcggtccaccacggcgtgatcctgtccggcgcgcggccggtatacctggactcgtcggtcaaccgccagtacgggattttcgggccggtgcccaagaccacgatttaccaggcgatagacgacaatccggacgcgcgagtgctgatcctcacctcctgcacctacgacggcctgcgctacgacctgaagcccatcatcgaggccgcgcacgagaagggcatcaaggtgatcgtcgacgaggcctggtacggcttcgcccgcttccaccccgcgttccggccgacggcgctggagtccggcgcggactacgtgacgcagagcacgcacaaggtgctgtcggcgttctcgcaggccagcatgatccacgtcaacgacccgcgcttcgacgagcatttgttccgagagaacttcaacatgcacgcgtccaccagccctcagtacagcctgatcgccagcctggacgtggcgcgcaagcaggcggtgatggagggctaccgcttgttggaccgcacgctgaagctggcgcaggagctgcgcgagaagatcaattccaccggcgccttccgcgtgctggagctggacgatctgctgccggaagaggtgagggaggacggcatcctgctggatccgaccaagctgaccgtggacttcagccgctccggcttcaccgccgacgaactgcagcaggcgctgttcgagcgttacaacattcaggtggagaagtcgacgttcagcaccatcacgctgctgctgaccatcggcaccacccgcagcaagctgtcccgactttacgacgcgatgctgaggctggccaaggagggccgtgcgccgcggccgctggggcgcatgccggagattccgcacttctcccggctggcctgcctgccgcgcgacgccttctacgaggccggcgagcgcctgccgctgctggacgacgacggccggccgaatccggcattgagcgggcgggtgtgctgcgaccagatcgtgccgtatccgcccggcatcccggtgctggtgccggggcaggtggtggacgacaccatcctggcctacctggcgcggctgcagaaaacgcagaagagcatcgagatgcacggcttggcggaggatggcggcgagttttacctgcgggtgctgaagccgcaggagctggcggaattgcccggccgcagtttgttcaattaa

SEQ ID NO: 393 - protein, 416 aa, Chromobacterium violaceum
MIFQTLLAPGDKLLLDRNCHKSVHHGVILSGARPVYLDSSVNRQYGIFGPVPKTTIYQAIDDNPDARVLILTSCTYDGLRYDLKPIIEAAHEKGIKVIVDEAWYGFARFHPAFRPTALESGADYVTQSTHKVLSAFSQASMIHVNDPRFDEHLFRENFNMHASTSPQYSLIASLDVARKQAVMEGYRLLDRTLKLAQELREKINSTGAFRVLELDDLLPEEVREDGILLDPTKLTVDFSRSGFTADELQQALFERYNIQVEKSTFSTITLLLTIGTTRSKLSRLYDAMLRLAKEGRAPRPLGRMPEIPHFSRLACLPRDAFYEAGERLPLLDDDGRPNPALSGRVCCDQIVPYPPGIPVLVPGQVVDDTILAYLARLQKTQKSIEMHGLAEDGGEFYLRVLKPQELAELPGRSLFN

SEQ ID NO: 394 - DNA, 2259 bp, Chromobacterium violaceum
  CDS (1)..(2259)
atgcgttttcacttccccatcgtgatcatcgacgaggacttccgctcggaaaacaccagcggctccggcattcgcgaactggccgccgccatggaggcggaaggcatgagcgtgatcggctacaccagctacggcgacctcacctccttcgcccagcagcaaagccgcgccgccggcttcatcctgtcgatagacgacgaggaattccagaccgaggacacggcgcaagaagcgctgggcaatctgtacggcttcgtcgccgaaatccgccgccgcaacccggacatcccggtctacctgtacggcgagacccgcaccgcccgccacatccccaacgacatcctgcgcgagctgcacggcttcatccacatgcacgaggacacgccggagttcgtcgcccgccacatcatccgcgaggccaagagctatctggacaagctggcgccgccgttcttccgcgcgctggtggactacgcctacgacggctcctactcctggcactgccccggccactccggcggcgtcgccttcctgaagagcccggtcggccagatgttccaccagttcttcggcgagaacatgctgcgcgccgacgtctgcaacgcggtggacgagctgggccagctgctggaccacaccggcccggtggcggcgtccgagcgcaacgcggcgcgcatcttcaatgccgaccacctgttcttcgtcaccaacggcacctccacctcgaacaagatcgtctggcacagctgcgtcgccgccggcgacatcgtgctggtggaccgcaactgccacaagtccaatctgcacgccatcatcatgaccggggccatcccggtgttcctgatgccgacgcgcaaccactacggcatcatcggcccgatcccgaagtccgagttccagccggacaatatcaagaagaagatcctggccaatccgttcgcgcgcgagatgctggaaaagcaccccaaccgcaagccgcgcatcctgacgctgacccagtccacctacgacggcatcctgtacaacgtcgaggagatcaagggcctgctggacggcgaggtggacacgctgcacttcgacgaagcctggctgccgcacgcctgcttccacgacttctaccgcgacttccacgccatcggcgaaggccggccccgctgcgaggacagcctggtgttctccacccagtccacccacaagctgttggccggcatcagccaggcctcgcagatcctggtgcaggatccgcagaaccggcagctcgacaccgcctggttcaacgaagcctacctgatgcacacctcgaccagcccgcaatactcgatcatcgccagctgcgacgtggccgccgcgatgatggagcagccgggcggccagtcgctggtggaagaatcgctggtggaggcgatggaattccgccgcgcgatgcgcaaggtggacgaggaatacggccgcgactggtggttcagcgtatggggcccggacgatctgtccgacgacggcatctgcgaccagaccgactggacgctgcgccccgacgagcgctggcacggcttcgccggcatcgaggacggcttcaacatgctggacccgatcaaggccaccgtgctgacgccgggcctggacgtggacggcagcttcgaggaaatgggcatcccggccgccatcgtcaccaagtatctgaccgaacacggcgtggtcgtcgagaaaaccggcctgtacagcttcttcatcatgttcaccatcggcatcaccaagggccgctggaacacgctgatctcgctgctgcagcagttcaaggacgatttcgacaagaaccagccgatgtggcgcgtgatgccggaattcgtcgccaagcatccgcagtacgagcgcgtcggcctgcaggacctgtgccagcgcatccacggcctgtacgccaagcacgacgtggcgcggctgaccaccgacatctacctgtccgacatggagccggcgatgcgcccggccgacgccttcgccaagatggcgcaccgcgagatcgagcgcgtgccggtggaccagctggaaggccgcgtcaccgcggtgctgctgaccccctacccgccgggcatcccgctgctgatcccgggcgagcgcttcaacaagaccatcgtcgactacctgcgcttcgcccaggccttcaaccgcgagctgccgggcttcgaaaccgacgtccacggcctggtggcggtggaggtgcaggaccgcaaggtgtactgcgtggactgcgtcaagcaataa

SEQ ID NO: 395 - protein, 752 aa, Chromobacterium violaceum
MRFHFPIVIIDEDFRSENTSGSGIRELAAAMEAEGMSVIGYTSYGDLTSFAQQQSRAAGFILSIDDEEFQTEDTAQEALGNLYGFVAEIRRRNPDIPVYLYGETRTARHIPNDILRELHGFIHMHEDTPEFVARHIIREAKSYLDKLAPPFFRALVDYAYDGSYSWHCPGHSGGVAFLKSPVGQMFHQFFGENMLRADVCNAVDELGQLLDHTGPVAASERNAARIFNADHLFFVTNGTSTSNKIVWHSCVAAGDIVLVDRNCHKSNLHAIIMTGAIPVFLMPTRNHYGIIGPIPKSEFQPDNIKKKILANPFAREMLEKHPNRKPRILTLTQSTYDGILYNVEEIKGLLDGEVDTLHFDEAWLPHACFHDFYRDFHAIGEGRPRCEDSLVFSTQSTHKLLAGISQASQILVQDPQNRQLDTAWFNEAYLMHTSTSPQYSIIASCDVAAAMMEQPGGQSLVEESLVEAMEFRRAMRKVDEEYGRDWWFSVWGPDDLSDDGICDQTDWTLRPDERWHGFAGIEDGFNMLDPIKATVLTPGLDVDGSFEEMGIPAAIVTKYLTEHGVVVEKTGLYSFFIMFTIGITKGRWNTLISLLQQFKDDFDKNQPMWRVMPEFVAKHPQYERVGLQDLCQRIHGLYAKHDVARLTTDIYLSDMEPAMRPADAFAKMAHREIERVPVDQLEGRVTAVLLTPYPPGIPLLIPGERFNKTIVDYLRFAQAFNRELPGFETDVHGLVAVEVQDRKVYCVDCVKQ

SEQ ID NO: 396 - DNA, 1404 bp, Gloeobacter violaceus
  CDS (1)..(1404)
atggaaaccactccgctctgggatgcgctgagggccgtcgctctagcctcgggcacgggctttcacaccccgggccacaacggcggggcgggcctgccgccagccctcaaacactggccggattggggccgtctggacctgaccgaacttgcaggactcgacaacctgcacgctcccaccggggtgatcgcccacgcgcaacggctcgcggcggcagtttggggagccgagcgcagttggtttctggtcaacggtgcgaccgccggaatccaggcgatgctgcttgcggcactcgggcaggggcagaaggtgctcgtgcccagaaactgtcaccaaagtatcgtgcacgccctggtgctgagcggcgcggtgccggtgttcgtccaacctgtatgggacaggcgctggcagttggcccacggactgacggcgacgacggtggaagccgccctggccgtccacccggacatccgggcggtggtggcggtgcacccgacgtacttcggggcggtgggcgagacgcgggccatcgccagggtcgcccacgcaaaagggattgcgctgttggtcgatgccgcccacggcgcccatctgcgcttccatccggacttgcccgagtgcgcactcgcagcgggagcggacttggtcgtccattccgcccacaagacactgcccgccctcacccaggcggcactccttcaccagcagggcaccctggtggacccggccagggtggagatggctctgaaccttctgcaaaccaccagcccgagctacttgctgatggcctcgctcgatctggcccgcgcccacatggtccgccacggccgcgagcagctcgggcacatcctggagatggcccatagactgcgacacaaactgcccttcgcggtgctcgggggcgacggaacgcctggcttcgatccgacccgcctggtcatcgacgtgggtgagaaaggctggagcggtcacgccgctgagacctggctggagcaaaacgcccaggtgcgtgcggagatggccacccaccgccacctggtcttcatcctcaatagcgcccacaccgaattcgacggcgagcaactgcaagcatcccttctggccctggcaacggcccaaccgaccggggcaacgccgccggatctgcttccaccgccgcttccggagctgcgctattcaccccgcgaagctttcggccgctcccaccggagcgttcccctagccgcggcagccggactgaccagtgcggccgatgtctgcacctacccgcccggagtgccggtgctgctgccgggggaagtggttgccgcccagagcgtcgagtatttgggcgccgccattgacactggggccgagacagtcgggatcgacgggcgcggacacatccgggtcactattgactaa

SEQ ID NO: 397 - protein, 467 aa, Gloeobacter violaceus
METTPLWDALRAVALASGTGFHTPGHNGGAGLPPALKHWPDWGRLDLTELAGLDNLHAPTGVIAHAQRLAAAVWGAERSWFLVNGATAGIQAMLLAALGQGQKVLVPRNCHQSIVHALVLSGAVPVFVQPVWDRRWQLAHGLTATTVEAALAVHPDIRAVVAVHPTYFGAVGETRAIARVAHAKGIALLVDAAHGAHLRFHPDLPECALAAGADLVVHSAHKTLPALTQAALLHQQGTLVDPARVEMALNLLQTTSPSYLLMASLDLARAHMVRHGREQLGHILEMAHRLRHKLPFAVLGGDGTPGFDPTRLVIDVGEKGWSGHAAETWLEQNAQVRAEMATHRHLVFILNSAHTEFDGEQLQASLLALATAQPTGATPPDLLPPPLPELRYSPREAFGRSHRSVPLAAAAGLTSAADVCTYPPGVPVLLPGEVVAAQSVEYLGAAIDTGAETVGIDGRGHIRVTID

SEQ ID NO: 398 - DNA, 2307 bp, Photorhabdus luminescens subsp laumondii
  CDS (1)..(2307)
atgattaatttagacattaacgaacaaaacaaaattatggtcgtcagcagccatgtatttagaccgacgacggcgaatggtcgagcctttaccgagttaatagaagcattaaaaaagaacaatttcgctgttatcctggcggctacattccaagatggcatagctaccgtttcttctgattcctcactatgctgtatttttgttgattggacttcaggagataataactatgaatctcataaacaagtgttagaattactgaaagagatacgcaaacacaatacaaccattccggtattgttgaccgcggaatattccagcatcgacacactgacacttgaagtcatgggattggcagatgaatttgtctggatgcttgaagacacggctggatttatcgcctctcgcgccagttcgctaattaagaaatattatgcgcaattattaccgcctttcactcgtgcattactgcaatacactcaagaatcaccagaatattcctggactgctcctggacatcaaggcggtgttgcactgactaagacagcggcaggaagagaattaattaatttctttggggaaaatttatttcgaagtgatattggaatagaaagaaaaatacttggctcactgctagatcatacaggtgcgattaaagaatcagaagaatatgccgcaacgatttttggtgcccatcaaagctattgcgtgcttaacggcacttcgggttctaaccgtattatcatgggtgccgttattggtgagaaagagattattatatgcgatcgcaattgccataaatcgattggacaaggtttaataatgactggggctttgcccgtatatcttattcctcaacgcaaccgctatggtattattggccccattcccagagatcaatttcaaccagaatatatccaacaactcattgatcaacacccattaaaagcgatcgcaatagacaataagcctgtttatgcggtcatcaccaactgtacttatgatggaatatgttatcacgcagaacaagcacaagatttactagcaaaaagtgttgatcaaattcattttgatgaagcctggtttgcttatgcgcgttttaatcctatgtataaacatcgttactcaatgcgtgatgacccaaatgattttgacaataatggcccgacaatatttgccactcaatccacgcataagatgttagcagcgctatcacaatcatcctatatccatatccgcaatggcaaaaaacccattgaacattcccgtttcaacgagtcttatatgatgcactccacaacttcaccgctatattcgcttatcgccactaatgaaattgcagcggccatgatggatggcccacaggggcaaagactgatacaaaacgctatcaatgaagccgtagacttccgtctgacattagcaaaaacccatcatcaatttaaacaaaaagatgattggtttttcttaccctggaatgccagagagattattagcgcagatagcggtaaattaattcccttccatgaagcaaacagagaacaattagcaacggatccttcctgttgggtattaaaagagggagaaaaatggcatggatttaccaatctatcagcagaatggtgcctgctagatccaacaaaagttggtattttatgcccaggaatgaatgataatgatgaattgctggaaaatggcattccagccgaaattctttccgcttatctcagccagcatgacattgtgccggcgcgtaccaccgattttattgttctttgcctgttttctatcggcgtcaccaaaggtaaatggggaacattaatcaatgtattgttgaatttcaagaaacactatgacgctaatacttcacttaaacaatgtttgccaaaactcgcgaagcaataccctgaatattatgaaaacatggggctcaaagatatttcggataaaatatttgggtatataaaagaatatgaaatggatattgagcaaaagaaatcatttagccaattacctgagatagtgaaactcccccgacaagcacaccttgatcatatggcaggccgtactgaacatttaccacttaatgaactcgccgggcgcatatcggctgtaagtgtcattccttatccaccaggtataccaataatcctaccgggagaacgttttggtgatgaacatgccccccggttacaatatattcgccaactcggtgaatggaataacaagttccccggctttgaaaaaatcctggaaggcgcagagatgataaacggcgagtaccatatatgggtactaaaagagtaa

SEQ ID NO: 399 - protein, 768 aa, Photorhabdus luminescens subsp laumondii
MINLDINEQNKIMVVSSHVFRPTTANGRAFTELIEALKKNNFAVILAATFQDGIATVSSDSSLCCIFVDWTSGDNNYESHKQVLELLKEIRKHNTTIPVLLTAEYSSIDTLTLEVMGLADEFVWMLEDTAGFIASRASSLIKKYYAQLLPPFTRALLQYTQESPEYSWTAPGHQGGVALTKTAAGRELINFFGENLFRSDIGIERKILGSLLDHTGAIKESEEYAATIFGAHQSYCVLNGTSGSNRIIMGAVIGEKEIIICDRNCHKSIGQGLIMTGALPVYLIPQRNRYGIIGPIPRDQFQPEYIQQLIDQHPLKAIAIDNKPVYAVITNCTYDGICYHAEQAQDLLAKSVDQIHFDEAWFAYARFNPMYKHRYSMRDDPNDFDNNGPTIFATQSTHKMLAALSQSSYIHIRNGKKPIEHSRFNESYMMHSTTSPLYSLIATNEIAAAMMDGPQGQRLIQNAINEAVDFRLTLAKTHHQFKQKDDWFFLPWNAREIISADSGKLIPFHEANREQLATDPSCWVLKEGEKWHGFTNLSAEWCLLDPTKVGILCPGMNDNDELLENGIPAEILSAYLSQHDIVPARTTDFIVLCLFSIGVTKGKWGTLINVLLNFKKHYDANTSLKQCLPKLAKQYPEYYENMGLKDISDKIFGYIKEYEMDIEQKKSFSQLPEIVKLPRQAHLDHMAGRTEHLPLNELAGRISAVSVIPYPPGIPIILPGERFGDEHAPRLQYIRQLGEWNNKFPGFEKILEGAEMINGEYHIWVLKE

SEQ ID NO: 400 - DNA, 2175 bp, Vibrio parahaemolyticus
  CDS (1)..(2175)
atggcagagagcgccttcattcgccttggagatgtccaaatgaatattttcgctatcttgaaccacatgggtgtgttctttaaagaagagccagttcgtcaacttcacgctgctcttgagaaagcgggctacgaagtggtttacccagtagatgataaagacttgatcaaaatgattgagatgaacccgcgcatttgcggtgtgctgttcgactgggataaatactcactagagctatgtgaacgtattagccaaatcaacgaaaaactgcctgttcacgcatttgctaacgaacagtctactctcgatatttcactaacagacctacgtctgaacgtgagcttcttcgagtacgctttaggtatggctgacgacatcgctatcaaaatcaaccaagcgacagaggcatacaaagatgccatcatgcctccattcactaaagcgctattcaaatacgtagaagaaggtaaatacaccttctgtactccaggtcacatgggcggtactgcattccagaaaagccctgctggtagcatcttctatgatttttacggtccaaatacattcaaagcggacgtatcaatctcaatgcctgagctaggttctctactagaccactcaggtccacataaagatgcagaagaatacatcgcacgtacattcaatgcagacagctcgtacatcgtaactaacggtacgtctacatcgaacaaaatcgttggtatgtactcagcacctgcgggcagcacagtactgattgaccgtaactgtcacaaatctctgactcacctaatgatgatgagcgacgtgacaccaatctacttccgtccaactcgtaacgcatacggcatccttggtggtattccacaaagcgaattcagccgtgatgtcattgcagagaaagtggcgaaaacaccaggtgcaacagcgccaagttacgcagtagtgactaactcaacttacgatggtctgttgtacaacacacaattcatcaaagagtcgctagactgtaaacacatccacttcgacagtgcttgggtgccttacactaacttcaacccaatttacgaaggtaaatgtggtatgagtggtgaagcgatgccaggcaaagtgttctacgagacacaatcaacacacaaactgttggcagcgttctcacaagcttcaatgattcacgtgaaaggtgactttgatagagagtctttcaacgaagcattcatgatgcacacttcaacttcacctcagtacggcattgttgcttctactgaaactgcagcggcaatgatgcgcggcaacactggtaagaagttgacgcaagactctatcgatcgcgcaattcgcttccgtaaagagatcaaacgcctagaagcagaaagtgacagctggttcttcgatgtatggcaaccagaaaacatcgataccacagaatgttggaaactagaccctagcgatacatggcacggcttcaagaacatggatgacaaccacatgtatcttgacccaatcaaagtcacgctactgactccggggatgaataaagaaggcgaactagaagaatcaggtattcctgcttcgctggtggctaaattcctagacgagcgcggcatcgtggtagagaaaacaggtccatacaacttgttgttcctattctcaattggtatcgacaaatcaaaagcaatgcaattgctacgcggtctgactgaatttaaacgtggctacgacttaaacctaaccatcaagagcttcctaccttcgctatataacgaagatccaagcttctatgaaggcatgcgcgttcaagaattggcacaagcaattcataacctaactaagaaatacaacctaccagagctaatgtacaaagcgttcgatgttcttccagaaatgaaagtaacaccacacgcagcatggcaagaagagcttcgcggtaacgtagaagaaatcaaactggaagaaatggttggtcgcgtaagtgcgaacatgatccttccctaccttccatatgtgccactagtacttcctggtgaaatggtgactcaagagtctcgccctgtgctggacttcctagagatgctttgtgagatcggggcgcattacccaggtttcgaaaccgatatccacggtctgtaccaacaaaaagatggtagctacaccgtaaaagtattgaagaactaa

SEQ ID NO: 401 - protein, 724 aa, Vibrio parahaemolyticus
MAESAFIRLGDVQMNIFAILNHMGVFFKEEPVRQLHAALEKAGYEVVYPVDDKDLIKMIEMNPRICGVLFDWDKYSLELCERISQINEKLPVHAFANEQSTLDISLTDLRLNVSFFEYALGMADDIAIKINQATEAYKDAIMPPFTKALFKYVEEGKYTFCTPGHMGGTAFQKSPAGSIFYDFYGPNTFKADVSISMPELGSLLDHSGPHKDAEEYIARTFNADSSYIVTNGTSTSNKIVGMYSAPAGSTVLIDRNCHKSLTHLMMMSDVTPIYFRPTRNAYGILGGIPQSEFSRDVIAEKVAKTPGATAPSYAVVTNSTYDGLLYNTQFIKESLDCKHIHFDSAWVPYTNFNPIYEGKCGMSGEAMPGKVFYETQSTHKLLAAFSQASMIHVKGDFDRESFNEAFMMHTSTSPQYGIVASTETAAAMMRGNTGKKLTQDSIDRAIRFRKEIKRLEAESDSWFFDVWQPENIDTTECWKLDPSDTWHGFKNMDDNHMYLDPIKVTLLTPGMNKEGELEESGIPASLVAKFLDERGIVVEKTGPYNLLFLFSIGIDKSKAMQLLRGLTEFKRGYDLNLTIKSFLPSLYNEDPSFYEGMRVQELAQAIHNLTKKYNLPELMYKAFDVLPEMKVTPHAAWQEELRGNVEEIKLEEMVGRVSANMILPYLPYVPLVLPGEMVTQESRPVLDFLEMLCEIGAHYPGFETDIHGLYQQKDGSYTVKVLKN

SEQ ID NO: 402 - DNA, 2358 bp, Rhodopseudomonas palustris
  CDS (1)..(2358)
atggactacttcaggcgtttcaccttcctgttctcggcaccgactttcgaggcggatgatctcgaaggcattcggttcaatcagatcgtcgcggagatcgagcggtccggcttcgagatcgtcaaggcgcgcaagctggaagatgccgagatcgcggtgcagaccgacgccgcgattggctgcatggtggtcgactggggcaagaagggcctcgagggcaagaccgccgcgctgatcaacctgatgcgccggcgcggtctcgatttcccgatcgtgctgctgatccgccgcaagaggttcgaggaagtgccggtcgaggtgctcgatttcatcgacggctacgtgtttctgtccgaggagacgccgaccttcatcgcccgcaacctgatcagccggctgaagcaatatgccgacacgctgaagacgccgttcttcggcgcgctggtcgactatgcggaggagggcaaccagctctggacctgccccggccacaacggcggcatgttctacagccgcagcccgatcgggcgggtgttcatcgagcatctcggcgaggcggtgttccgcgatgacctcgataattcggtgctcgaccttggcgatctgttgacccacgaggggccggcgctgcgcgcgcagaaggaagccgcgcagatcttcggtgccgagaagacctatttcgtgctcaacggcacctcgacctccaacaaggtcgccctcggcgcgctcgtctccgacggcgatctgatcctgttcgatcgcaacaatcacaaggcggcccatcacggcgcgctgatgatgggcggcggcattcccgtctacattcccacggttcgcaacgcctggggcctgatcgggccgatggcgtgggacgcgctggacgagacggcgctgcgcgaacgcattcgcagccatccgctggtcaaggaccctgaggcctggcgcaagccgcgcccgttccgcgtcgcggtggtcgaacagtgcacctacgacggcaccatccacagcgccgagatgatcctgcgccgcatcgggcatttgtgcgattacatcctgttcgacgaagcctgggccggcttcatgaagtttcatccgctgtatgccggccgcttcgcgatggggctggcgaacctcggcgacgatgcgcccggcatcatcgcgacgcagtcgacccacaagcagctcgccagtttctcccaggcgtcgcagatccacatcaaggatcgccacatccgcggccagaagcggcgggtcgagcatcggcgcttcaacgagagcttcatgcagcacgcctcgacgtcgccgttctatccgctgttcgcctcgctcgatgtcggcgcgcagatgatgaagggccgctccggcgaagtgctatgggacgatacgatccggcttggcatcgagctgcgcaagaagatccgcgcggtgcggagggagttcgaggagaaggaggcgcgggcggagcggcgctggttcttcgatccgttcgtgcccgatcgggtgacgatcgcggacgccgcccgtgaaggcgcggtgcacgatgtcgcctgggaggccgtgagcaccgaccagctcgcgaccgacccgacattctggcagatcgcgccgggcgcggcctggcacggctttgccgatatggcgcctggcttcgccatgaccgacccgaacaagctgacgctgctgacgccgggcttcgaccgggccaccggccgctatgccgagcacggcgtgccggcgccggtggtggcgcaatatctgcgcgagaaccgcattgttccggaaaagaacgatctcaactcgctgctatttctgctgacgccgggcgtcgaggcgagcaaggccggtacgctgatcagcggcctcgtcgcgttcaagaagctgcacgacgacaacgcgccgctcgacgaggtgatcccggaattcagccggcgccggcccgctcgctatgccggggtacggctgcgcgatttgtgcgggcagatgcaccggttcttccgcgacgccgatgtcagcgcgctgcaggccaagcagtttctgcccgaacatctacccgagatcgcgatgtcgccgcacgatgcggcgcgctgcctggtccgcaatgacgtcgactatctgccgatcagccagatcgcgggccggatcgccaccacgccgttcgtggtctatccgccggggatcgcgaccatcgtgcccggcgagcggctgagcgagcgagccaagccgatgctcgattacttgcagatgttcgagcgcagcttcaacgaattccccggcttcgaagtcgagattcagggcgtctatcgcgaattcgatgaattgggccgggttcgtctctacacctacgtcgtggccgaataa

SEQ ID NO: 403 - protein, 785 aa, Rhodopseudomonas palustris
MDYFRRFTFLFSAPTFEADDLEGIRFNQIVAEIERSGFEIVKARKLEDAEIAVQTDAAIGCMVVDWGKKGLEGKTAALINLMRRRGLDFPIVLLIRRKRFEEVPVEVLDFIDGYVFLSEETPTFIARNLISRLKQYADTLKTPFFGALVDYAEEGNQLWTCPGHNGGMFYSRSPIGRVFIEHLGEAVFRDDLDNSVLDLGDLLTHEGPALRAQKEAAQIFGAEKTYFVLNGTSTSNKVALGALVSDGDLILFDRNNHKAAHHGALMMGGGIPVYIPTVRNAWGLIGPMAWDALDETALRERIRSHPLVKDPEAWRKPRPFRVAVVEQCTYDGTIHSAEMILRRIGHLCDYILFDEAWAGFMKFHPLYAGRFAMGLANLGDDAPGIIATQSTHKQLASFSQASQIHIKDRHIRGQKRRVEHRRFNESFMQHASTSPFYPLFASLDVGAQMMKGRSGEVLWDDTIRLGIELRKKIRAVRREFEEKEARAERRWFFDPFVPDRVTIADAAREGAVHDVAWEAVSTDQLATDPTFWQIAPGAAWHGFADMAPGFAMTDPNKLTLLTPGFDRATGRYAEHGVPAPVVAQYLRENRIVPEKNDLNSLLFLLTPGVEASKAGTLISGLVAFKKLHDDNAPLDEVIPEFSRRRPARYAGVRLRDLCGQMHRFFRDADVSALQAKQFLPEHLPEIAMSPHDAARCLVRNDVDYLPISQIAGRIATTPFVVYPPGIATIVPGERLSERAKPMLDYLQMFERSFNEFPGFEVEIQGVYREFDELGRVRLYTYVVAE

SEQ ID NO: 404 - DNA, 2853 bp, Mycobacterium paratuberculosis
  CDS (1)..(2853)
atgatccgatacagcacccagccgcgacggctgcgggtgtccgcgctggcggccgtggccaacccgtcgtacgcccgggtggacacctggaacctgctcgacgacgcctgccggcacctcgccgaggtcgacctggccgggctggacaagacgcacgacgtggcccgggtgaagcgcctgctggaccgcatcgccgcctacgagcgctactggctgtaccccggcgcggagaacctggcgatcttccgcgcccacctggacagcctgtccacggtgcggctcaccgaggaggtctccctggcggtgcggctgttgagcgaatacggcgatcgcgcagggcttttcgacacgtcggcgccgctggacgaccaggagctggtggcccaggccaagcaacagcatttctacaccgtgctgctggccgacgacgcccccagcaccgcaccggacagcctggccgaatgcctgcgggcgctgcgcaacccgtccgacgacgtgcagttcgagatcctggtggtgcccagcgtcgaggacgccatcaccgcggtcgcgctgaacggggagatccaggccgcgatcatccgcgacgacctgccgctgcgctcccgcgaccggctgccgctgatgaacaccctgctcgggcccaacgaggacgcggacggcgtcatccccgaccgcgccaacgactgggtggagtgcggcgagtggatccgcgagctgcgcccgcacatcgacctgtatctgctcaccgacgaatcgatcgcggcgggcgacgacaccgaacccgacgtctacgaccgcaccttctaccggctcaacgacgtcaccgacctgcacagcacggtgctcgccgggctgcggaaccgttatgccacaccgtttttcgacgcgctgcgggcgtacgcggcggccccggtcggccagttccacgcgctgccggtggcgcgcggggccagcatcttcaactcccgctcgctgcaggacatgggggagttctacggccgcaacatcttcatggccgaaacctccaccacctccggcggcctggactcgctgctggacccgcacggcaacatcaagaaggcgatggacaaggcggccaagacctggaacgccgaccacacctacttcgtcaccaacggcacgtcgaccgccaacaagatcgtcgtgcagtcactgacccggcccggcgacatcgtgctgatcgaccgcaactgccacaagtcgcaccactacgggctggtgctggccggggcgtacccgctgtacctggacgcctatccgttgccgcagttcgcgatctacggggcggtgtcgctgcgcaccatcaagcagaccctgctggacctggaggcggccgggcagttgcaccgggtgcggatgctgctgctgaccaactgcaccttcgacggcgtggtctacaacccgctgcaggtcatgcaggaggtgctggcgatcaagccggacatctgctttttgtgggacgaggcgtggtacgcgttcgccaccgccgtgccgtgggccaggcagcgcaccgcgatggtggccgccgagcggctcgagcagatgctggcctcgccggattacgttgagcaataccggaaatgggccgcgtcgatgcagggcgtggaccgttcggagtggatcgagcgggagctgctgcccgaccccgccaccgcccgggtgcgggtctacgccacccattccacgcacaagtcgctctcggcgctgcgccaggcgtcgatgatccacgtgcgggaccaggatttcaacgcgctcacccgcgacgcgttcggtgaggcgtttttgacccacacctcgacctcgcccaaccagcagctgctggcgtcgctggatctggcccgccgccaggtcgacatcgagggcttccagctggtccggcaggtctacgacatggcgctggtgttccggcaccgggtccgcaaggaccggttgatcagcaagtggttccgcatcctcgacgagtccgacctggtgcccgaggagttccgggcgtcgtcggtgagctcctaccgcgaggttcggcagggggcgctggccgagtggaacgaggcgtggcgctccgaccagttcgtgctggacgccacccgggtcaccctgttcgtcggcgccaccggcatgaacgggtacgacttccgggagaagatcctgatggaacgcttcggcatccagatcaacaagacctcgatcaacagcgtgctgctgatcttcaccatcggcgtcacctggtccagcgtccactatctgctcgacgtgttacgaagggtggcaacggatttcgatcgcatccagaaggaggccagtgccgccgaccgggcgctgcaacgacgccacgtcgaggagatcaccgaggaccttccgcacctgcccgacttcagcgaatttgacgtcgccttccggccggtcgacgaatgcaacttcggcgacatgcggtcggcgttctacgccgggtacgaggagtccgaccgcgagcacgtgctgatcggcacggccgggcggcggctggccgagggcaagaacctggtgtcgaccaccttcgtggtgccctacccgccgggtttcccggtgctggtgcccggccaggtggtgtccaaggagatcgtctacttcctggcccagctcgacgtgaaggaaatccacggctacaacccggatttggggctgtcggtgttcaccgacaccgcgctggcgcggatggaggcgcagcgcaacgccgcgaccgccgcggtgggttcggtgaccgcggccttcgagttgcccgcggacgcctccggcggcaacggggcgcacaacggcgccggcgcggtgccgtcggtcgccgacggcggctaa

SEQ ID NO: 405 - protein, 950 aa, Mycobacterium paratuberculosis
MIRYSTQPRRLRVSALAAVANPSYARVDTWNLLDDACRHLAEVDLAGLDKTHDVARVKRLLDRIAAYERYWLYPGAENLAIFRAHLDSLSTVRLTEEVSLAVRLLSEYGDRAGLFDTSAPLDDQELVAQAKQQHFYTVLLADDAPSTAPDSLAECLRALRNPSDDVQFEILVVPSVEDAITAVALNGEIQAAIIRDDLPLRSRDRLPLMNTLLGPNEDADGVIPDRANDWVECGEWIRELRPHIDLYLLTDESIAAGDDTEPDVYDRTFYRLNDVTDLHSTVLAGLRNRYATPFFDALRAYAAAPVGQFHALPVARGASIFNSRSLQDMGEFYGRNIFMAETSTTSGGLDSLLDPHGNIKKAMDKAAKTWNADHTYFVTNGTSTANKIVVQSLTRPGDIVLIDRNCHKSHHYGLVLAGAYPLYLDAYPLPQFAIYGAVSLRTIKQTLLDLEAAGQLHRVRMLLLTNCTFDGVVYNPLQVMQEVLAIKPDICFLWDEAWYAFATAVPWARQRTAMVAAERLEQMLASPDYVEQYRKWAASMQGVDRSEWIERELLPDPATARVRVYATHSTHKSLSALRQASMIHVRDQDFNALTRDAFGEAFLTHTSTSPNQQLLASLDLARRQVDIEGFQLVRQVYDMALVFRHRVRKDRLISKWFRILDESDLVPEEFRASSVSSYREVRQGALAEWNEAWRSDQFVLDATRVTLFVGATGMNGYDFREKILMERFGIQINKTSINSVLLIFTIGVTWSSVHYLLDVLRRVATDFDRIQKEASAADRALQRRHVEEITEDLPHLPDFSEFDVAFRPVDECNFGDMRSAFYAGYEESDREHVLIGTAGRRLAEGKNLVSTTFVVPYPPGFPVLVPGQVVSKEIVYFLAQLDVKEIHGYNPDLGLSVFTDTALARMEAQRNAATAAVGSVTAAFELPADASGGNGAHNGAGAVPSVADGG

SEQ ID NO: 406 - DNA, 1458 bp, Mycobacterium paratuberculosis
  CDS (1)..(1458)
atggaccaatccgacgcacctttgctcaacgcgctggccgactatcgcgacaagaaccggtacgggttcgcgccgcccgggcaccggcagggccgcggcaccgacgatcgggtcctcgcggtgctgggccgcgagccctttctcgacgacgtgctggccagcggcgggctcgacgaccgtcgcgccagcaacggctacctgcagcgcgcggaggacctgatggccgaggccgtcggcgccgagatcgcctggttctccacctgcggcagctccctgtcggtgcgcgcggcgatgatggcggtggccggtgggcagggcagcctgctggtcggccgggacagccacaagtcgatcgtggcggggctgatcttctccggggtgcagccgcgctggatcactccccgctgggacgccgagcgccacttttctcatccgccctcgccgcagcaggtcgaagaggcctgggacaagcatcccgatgccgccggtgcgctggtcgtcagccccagcccgtacggcacctgcgccgacatcgccggcatcgccgaggtgtgtcatcggcggggcaagccgttgatcctcgacgaggcgtggggggcgcatctgccgttccacgaggacctgccaacctgggcgatggatgccggcgccgacgtgtgcgtggtcagcgtgcacaagatgggcgccggtttcgagcagggctcggtgttccacgtccagggcgacctcatcgaccgggaccgcctctcggcgtgcgcggatctgctgatgaccaccagccccaacgtcctgatctacgcggcgatggatggctggcgccggcagatggtgcagcacggtcaccaattgctcggcgctgcattggatttggcgcggcaggtgcgcgacgagatcgagctcattcccgatgtggaggtgctcgacgacgagctgctgggcgtgcaggcgtcccacgacctggaccgcatgcaggtgctgatcgacgtatgcggcaccggcacatcgggttatcaggccgccgactggctgcgcgagcacgcgcgcatcgacgtgggcatgagcgaccaccgccgcatcctggccaccttgtccatggccgacgacaaggagacgttgggtcgtctcaccgatgcgctgcgggcgtggcgcaccgcggcgcaggacttcgaccccgccccccggatcgcgctgccgtcgccgtccgaaatgcagttggagacggtcgaattgccacgcgacgcgtttttcggacgggtgcaggaggtgccgaccaaaaccgccgccggccggatcgccgccgaacagatcacgccctatcccccgggcatccccgccgtcgtccccggcgagcggctcaatgatgctgtgctggactacctttgctccggggtggccgcggggatgaacctgcccgacgcggccgatccgtcgctgcagaccatccgggtgctcgcctaa

SEQ ID NO: 407 - protein, 485 aa, Mycobacterium paratuberculosis
MDQSDAPLLNALADYRDKNRYGFAPPGHRQGRGTDDRVLAVLGREPFLDDVLASGGLDDRRASNGYLQRAEDLMAEAVGAEIAWFSTCGSSLSVRAAMMAVAGGQGSLLVGRDSHKSIVAGLIFSGVQPRWITPRWDAERHFSHPPSPQQVEEAWDKHPDAAGALVVSPSPYGTCADIAGIAEVCHRRGKPLILDEAWGAHLPFHEDLPTWAMDAGADVCVVSVHKMGAGFEQGSVFHVQGDLIDRDRLSACADLLMTTSPNVLIYAAMDGWRRQMVQHGHQLLGAALDLARQVRDEIELIPDVEVLDDELLGVQASHDLDRMQVLIDVCGTGTSGYQAADWLREHARIDVGMSDHRRILATLSMADDKETLGRLTDALRAWRTAAQDFDPAPRIALPSPSEMQLETVELPRDAFFGRVQEVPTKTAAGRIAAEQITPYPPGIPAVVPGERLNDAVLDYLCSGVAAGMNLPDAADPSLQTIRVLA

SEQ ID NO: 408 - DNA, 2100 bp, Lactobacillus johnsonii
  CDS (1)..(2100)
atgaattttctaaaaattgcattaagcaatcaacttaaaaataatgattttaattcatggcaaactactaatttgaacgatgaaactcaagctagtgaacttgccgctattgttgtagcagagactgataaaagtagtcttaaaactgctcaagatttacaaaaaaaatcagggcttggaattcctattattaaagtttcacatgaaacaatttctaataatgaaaaaaatcaaataattgatgccgcaaatcaatacacagcagaaatggttcctggctttttaactgatttggtcaatttcgcagaagatcgtccaattagttttacgacaccaggtcatcataatggcttatattacgaaaaacatccggcgggggtagtatttaatcgcttctttggtaaaaacctcatgtttgcggataccagtgatacagtaccagaattaggcgatactatgacccacgaagggacgcctttaactgctgagcaaaaagctgccgaaacttatcatgctgataaagtttatttctgtactaatggaacaacgagtgcaaattcaatttgtgcaagtgcactattaactaaagatgacctagttctttttgatcgaaataatcataaatccctctataacagtgccttagtaatgactggtgccaaacctgtatatattccaactgatcgtaatgcacttggattaattggagaaatggatcctgactttttaaatgaagaaaaaattcgagctgaaattgctaaagttgaccctgaaaaagctaaagctaagcgtccatttagactagctatcattcaatcagaaacatatgatggtcttttttacgacgcgaagtggatgattgataaaattggtaaactatgcgattacattctttttgattgtgcttggggtggattcgaacagtttgttccaattatgaatcacctgtctcccctcaacttagactttgggtcagaagatccgggtattttagtaactcaatcacttcataaacaacaagccggaatgggccaagcctcacaaattttgaaaaaggatgctcatattaaaggtcagaaacgttacgttgatcataagcactttaaccacgcttatcttaaatttgttacctcaagttactcttatccactttatgcctcactcaccgttaactcatatttaaccagcggtgagggtaataaaaaatggtgggaccaaatcttacgcttaggaattgaatggcggaaagaattaattaaaaaatcaaaattatttaagccactagtaattgataattttgaaaatattagtactgatgagttagctacaaatgaaaagtactggaatttagattccactaatctgtggcatggatttagcaaaattgcgtctggtcaggccatgatcgatcctctaaaaattactgttgtaactcccggaattgatgttaaaaatgcaaaatatgaagaaataggtattcctggaccagttgttgcagaatttttaatggagaagcggattattcgtgcaaaagatgacctatattctcttcttttcttattaacgccgggagatactaaggctgaattagatatcttgctgaatgcattcttagaatttgaacaatattataacgaggatgcacctctagacaaagtgctccctaagctaactaaagtatacggcgatcgctacaaaggttataccttaaaacagctctgccaagaaatgcatgaatattaccggggaaataatacctttaccctccagcaagaattatttgcgaaaccagatatgcaaaattatcaaatgactcccgagcatgctgactatctctttatgaaaaatgaaagtgaattagttaacttagaagatgttaaaggtcgcattgctgctgaaggtgccttaccttacccaccaggcgtgttcattgttgcgcccggcgaaaaatggagcgatattgatcaaaaatattttgaagttttagtaggtgctatcgagcgtttcccaggctttgtacctgaaattcagggagtctactgggatcaaaaatcagatggtaaaataagagtacaagcagaagtattaaaggagaattaa

SEQ ID NO: 409 - protein, 699 aa, Lactobacillus johnsonii
MNFLKIALSNQLKNNDFNSWQTTNLNDETQASELAAIVVAETDKSSLKTAQDLQKKSGLGIPIIKVSHETISNNEKNQIIDAANQYTAEMVPGFLTDLVNFAEDRPISFTTPGHHNGLYYEKHPAGVVFNRFFGKNLMFADTSDTVPELGDTMTHEGTPLTAEQKAAETYHADKVYFCTNGTTSANSICASALLTKDDLVLFDRNNHKSLYNSALVMTGAKPVYIPTDRNALGLIGEMDPDFLNEEKIRAEIAKVDPEKAKAKRPFRLAIIQSETYDGLFYDAKWMIDKIGKLCDYILFDCAWGGFEQFVPIMNHLSPLNLDFGSEDPGILVTQSLHKQQAGMGQASQILKKDAHIKGQKRYVDHKHFNHAYLKFVTSSYSYPLYASLTVNSYLTSGEGNKKWWDQILRLGIEWRKELIKKSKLFKPLVIDNFENISTDELATNEKYWNLDSTNLWHGFSKIASGQAMIDPLKITVVTPGIDVKNAKYEEIGIPGPVVAEFLMEKRIIRAKDDLYSLLFLLTPGDTKAELDILLNAFLEFEQYYNEDAPLDKVLPKLTKVYGDRYKGYTLKQLCQEMHEYYRGNNTFTLQQELFAKPDMQNYQMTPEHADYLFMKNESELVNLEDVKGRIAAEGALPYPPGVFIVAPGEKWSDIDQKYFEVLVGAIERFPGFVPEIQGVYWDQKSDGKIRVQAEVLKEN

SEQ ID NO: 410 - DNA, 2268 bp, Escherichia coli
  CDS (1)..(2268)
atgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 411 - protein, 755 aa, Escherichia coli
MKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 412 - DNA, 2136 bp, Escherichia coli
  CDS (1)..(2136)
atgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaa

SEQ ID NO: 413 - protein, 711 aa, Escherichia coli
MKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPYRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVEIGIEARKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLVEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGVKRLYGYVLK

SEQ ID NO: 414 - DNA, 2196 bp, Lactobacillus sp strain 30a
  CDS (1)..(2196)
atgagttcttctcttaaaattgcttcgactcaagaagcgcgtcaatatttcgatactgaccgcgttgttgtcgatgctgtaggctctgattttactgatgtcggtgctgttatcgcaatggattacgaaacagatgtcatcgacgctgctgatgcaactaagtttggtattcctgtttttgccgtaactaaggatgcccaagctatcagtgctgatgagctgaagaagattttccacatcattgatttggaaaacaaatttgatgctactgttaacgctcgtgaaatcgaaactgctgttaacaactacgaagacagcattttaccaccattcttcaagtcattgaaagaatacgttagccgtggtttaatccaattcgactgcccaggtcaccaaggtggtcaatactacagaaagcacccagctggtcgtgaattctacgacttcttcggcgaaactgtcttccgtgcagacttatgtaacgctgacgttgccttgggtgacttgctgatccacgaaggtcctgctgttgctgctgaaaagcatgctgcacgtgtttacaacgctgacaagacttacttcgttttaggtggttcttccaacgctaacaacactgtaacatctgctttagtttctaacggcgacttggtattgttcgaccggaacaaccacaagtccgtttacaactcagctttagctatggctggtggccgtcctgtttacctccaaacaaaccgtaacccatacggcttcatcggtggtatctacgacagcgacttcgatgaaaagaagatccgtgaactggcagctaaggttgacccagaacgtgctaagtggaagcgtccattccgtctggctgttatccaattaggtacttacgatggtactatctacaacgcacacgaagttgtaaagcgtatcggtcacctttgtgattacatcgaattcgactctgcttgggtaggttacgaacaattcattcctatgatgcgtaactcttcaccattattgattgatgaccttggtccagaagatcctggtatcattgttgttcaatcagttcacaagcaacaagccggcttctcacaaacttcacaaatccacaagaaggatagccacatcaagggtcaattacgttactgtgaccacaagcactttaacaactccttcaacttgttcatgtctacttcaccattctacccaatgtatgcagcattagacgttaacgctgctatgcaagaaggcgaagcaggtcgcaagttatggcatgaccttctgattactaccattgaagctcgtaagaagttgatcaaggctggctcaatgttccgtccattcgttccacctgttgttaacggcaagaagtgggaagatggcgacactgaagatatggctaacaacattgactactggcgctttgaaaagggtgctaagtggcatgcttacgaaggctacggcgacaaccaatactacgttgatccaaacaagttcatgttaactacacctggtatcaacccagaaactggtgactacgaagacttcggtgttccagctactatcgttgctaactacttacgtgaccacggtatcatccctgaaaagtctgacttgaactctatcttgttcttgatgactccagctgaaactccagctaagatgaacaacctgatcactcaacttcttcaattacaacgcttgatcgaagaagatgctccattgaagcaagttcttccttcaatctacgctgctaacgaagaacgttacaatggctacactatccgtgaactttgccaagaattgcacgacttctacaagaacaacaacacgttcacataccagaagcgtctcttcttacgtgaattcttcccagaacaaggtatgcttccatacgaagctcgtcaagaattcatccgcaaccacaacaagcttgttccattgaacaagatcgaaggcgaaatcgccctcgaaggtgctcttccataccctccaggagtattctgtgtagcaccaggtgaaaagtggtcagaaactgctgttaagtacttcactatcttacaagatggtatcaacaacttccctggattcgctccagaaatccaaggtgtatacttcaagcaagaaggcgacaaggttgttgcttacggtgaagtttacgatgcagaagttgctaagaacgatgatcgttacaacaactaa

SEQ ID NO: 415 - protein, 731 aa, Lactobacillus sp strain 30a
MSSSLKIASTQEARQYFDTDRVVVDAVGSDFTDVGAVIAMDYETDVIDAADATKFGIPVFAVTKDAQAISADELKKIFHIIDLENKFDATVNAREIETAVNNYEDSILPPFFKSLKEYVSRGLIQFDCPGHQGGQYYRKHPAGREFYDFFGETVFRADLCNADVALGDLLIHEGPAVAAEKHAARVYNADKTYFVLGGSSNANNTVTSALVSNGDLVLFDRNNHKSVYNSALAMAGGRPVYLQTNRNPYGFIGGIYDSDFDEKKIRELAAKVDPERAKWKRPFRLAVIQLGTYDGTIYNAHEVVKRIGHLCDYIEFDSAWVGYEQFIPMMRNSSPLLIDDLGPEDPGIIVVQSVHKQQAGFSQTSQIHKKDSHIKGQLRYCDHKHFNNSFNLFMSTSPFYPMYAALDVNAAMQEGEAGRKLWHDLLITTIEARKKLIKAGSMFRPFVPPVVNGKKWEDGDTEDMANNIDYWRFEKGAKWHAYEGYGDNQYYVDPNKFMLTTPGINPETGDYEDFGVPATIVANYLRDHGIIPEKSDLNSILFLMTPAETPAKMNNLITQLLQLQRLIEEDAPLKQVLPSIYAANEERYNGYTIRELCQELHDFYKNNNTFTYQKRLFLREFFPEQGMLPYEARQEFIRNHNKLVPLNKIEGEIALEGALPYPPGVFCVAPGEKWSETAVKYFTILQDGINNFPGFAPEIQGVYFKQEGDKVVAYGEVYDAEVAKNDDRYNN

SEQ ID NO: 416 - protein, 1269 aa, Consensus
  misc_feature (1)..(302): Xaa can be any naturally occurring amino acid
  misc_feature (304)..(307): Xaa can be any naturally occurring amino acid
  misc_feature (309)..(322): Xaa can be any naturally occurring amino acid
  misc_feature (326)..(327): Xaa can be any naturally occurring amino acid
  misc_feature (329)..(359): Xaa can be any naturally occurring amino acid
  misc_feature (361)..(362): Xaa can be any naturally occurring amino acid
  misc_feature (364)..(367): Xaa can be any naturally occurring amino acid
  misc_feature (369)..(372): Xaa can be any naturally occurring amino acid
  misc_feature (374)..(377): Xaa can be any naturally occurring amino acid
  misc_feature (379)..(391): Xaa can be any naturally occurring amino acid
  misc_feature (393)..(407): Xaa can be any naturally occurring amino acid
  misc_feature (409)..(414): Xaa can be any naturally occurring amino acid
  misc_feature (417)..(417): Xaa can be any naturally occurring amino acid
  misc_feature (421)..(489): Xaa can be any naturally occurring amino acid
  misc_feature (492)..(492): Xaa can be any naturally occurring amino acid
  misc_feature (494)..(516): Xaa can be any naturally occurring amino acid
  misc_feature (518)..(518): Xaa can be any naturally occurring amino acid
  misc_feature (520)..(525): Xaa can be any naturally occurring amino acid
  misc_feature (527)..(591): Xaa can be any naturally occurring amino acid
  misc_feature (593)..(593): Xaa can be any naturally occurring amino acid
  misc_feature (596)..(601): Xaa can be any naturally occurring amino acid
  misc_feature (603)..(603): Xaa can be any naturally occurring amino acid
  misc_feature (605)..(606): Xaa can be any naturally occurring amino acid
  misc_feature (608)..(634): Xaa can be any naturally occurring amino acid
  misc_feature (638)..(638): Xaa can be any naturally occurring amino acid
  misc_feature (640)..(642): Xaa can be any naturally occurring amino acid
  misc_feature (644)..(656): Xaa can be any naturally occurring amino acid
  misc_feature (658)..(671): Xaa can be any naturally occurring amino acid
  misc_feature (673)..(759): Xaa can be any naturally occurring amino acid
  misc_feature (762)..(796): Xaa can be any naturally occurring amino acid
  misc_feature (798)..(799): Xaa can be any naturally occurring amino acid
  misc_feature (801)..(822): Xaa can be any naturally occurring amino acid
  misc_feature (824)..(917): Xaa can be any naturally occurring amino acid
  misc_feature (919)..(927): Xaa can be any naturally occurring amino acid
  misc_feature (932)..(936): Xaa can be any naturally occurring amino acid
  misc_feature (940)..(1269): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXLXXXXXXXXXXXXXXPGHXXGXXXXXXXXXXXXXXXXXXXXXXXXXXXXXXXLXXLXXXXGXXXXAXXXXAXXXXXXXXXXXXXGXXXXXXXXXXXXXXXGXXXXXXRNXHKSXXXXXXXXXXXXXXXXXXXXXXXXXXXXXXXXXXXXXXXXXXXXXXXXXXXXXXXXXXXXXXXXXXXXXTYXGXXXXXXXXXXXXXXXXXXXXXXXDXAXXXXXXFXXXXXXXXXXXXXXXXXXXXXXXXXXXXXXXXXXXXXXXXXXXXXXXXXXXXXXXXXXXXXXXXXSXHKXXXXXXQXSXXHXXXXXXXXXXXXXXXXXXXXXXXXXXXTSPXYXXXAXXXXXXXXXXXXXGXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXDPXXXXXXXXXXXXXXXXXXXXXXXXXXXXXXXXXXXIXXEXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXYPPGXXXXXPGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 417 - DNA, 723 bp, Escherichia coli
  CDS (1)..(723)
atgggacacaagcccttataccggcagattgccgatcgcattcgtgaacaaattgcgcgtggcgagcttaaacctggcgatgcgttacccactgaatcagcgctacaaacagagtttggcgtcagccgggttacggtgcgtcaggctttgcgccagctagtcgagcagcagatcctcgaaagcattcagggcagcgggacttacgtcaaagaagagcgggtcaattacgatatttttcagttaaccagttttgatgaaaaactgtcggaccgtcacgtcgatacacacagtgaagttctgatattcgaagtgattccggctgacgattttcttcagcaacagctacaaatcaccccgcaggatcgtgtgtggcatgtgaagcgcgtgcgctatcgcaagcaaaagccaatggcgctggaagaaacctggatgccgcttgcgttgttcccggatctcacctggcaggtcatggaaaattcgaaatatcactttatcgaagaagtgaagaaaatggttatcgatcgtagcgaacaggaaatcattcctctgatgccaaccgaagagatgagccgtctgcttaatatcagccagacaaagccgattcttgaaaaagtatcgcgtggatatttagttgatggtcgggtgtttgaatatagccgcaacgcttttaataccgatgactataaatttaccctgatagcgcagcgaaaatcatcgcgataa

SEQ ID NO: 418 - protein, 240 aa, Escherichia coli
MGHKPLYRQIADRIREQIARGELKPGDALPTESALQTEFGVSRVTVRQALRQLVEQQILESIQGSGTYVKEERVNYDIFQLTSFDEKLSDRHVDTHSEVLIFEVIPADDFLQQQLQITPQDRVWHVKRVRYRKQKPMALEETWMPLALFPDLTWQVMENSKYHFIEEVKKMVIDRSEQEIIPLMPTEEMSRLLNISQTKPILEKVSRGYLVDGRVFEYSRNAFNTDDYKFTLIAQRKSSR

SEQ ID NO: 419 - DNA, 23 bp, Primer
atgggacacaagcccttataccg

SEQ ID NO: 420 - DNA, 23 bp, Primer
ttatcgcgatgattttcgctgcg

SEQ ID NO: 421 - DNA, 729 bp, Bacillus subtilis
  CDS (1)..(729)
atgttaaacaacggaagttctacacctttatacattcagctaaaacaaatcatcactgatgacatcaaaaagggcgtgtattccccaaccgccaagctgcctaccgaaaacgagctttgcaccaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatcaaccggcaaaaaaccgaagcatcatgtgctgtcccatgacatcattccagcgtcaaaacccatcgccgaaaagcttcaaatccaacccgagagccctgtggttgaattaaaacggattttatataatgatgatcagcctctcacctttgaagtgacgcattatccgcttgatttgtttcccggcattgatacctttattgctgacggcgtctccatgcatgatattttgaaacagcaatacaaagttgtacccacgcacaatacgaagctattaaacgttgtatatgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataa

SEQ ID NO: 422 - protein, 242 aa, Bacillus subtilis
MLNNGSSTPLYIQLKQIITDDIKKGVYSPTAKLPTENELCTKYNVSRITVRKAILDLVEEGYLIRQQGKGTFVKSPKLKRELIAVNGYSEFMESTGKKPKHHVLSHDIIPASKPIAEKLQIQPESPVVELKRILYNDDQPLTFEVTHYPLDLFPGIDTFIADGVSMHDILKQQYKVVPTHNTKLLNVVYAQQEESKYLDCDIGDALFEIDKTAFTSNDQPIYCSLFLMHTNRVTFTINSPYT

SEQ ID NO: 423 - DNA, 717 bp, Escherichia coli
  CDS (1)..(717)
atgatctacaaaagcattgcggagcggttaagaattcgacttaactccgcagatttcacgctaaacagccttcttcccggtgaaaaaaagctggcggaagagtttgcggtatcgcggatgaccatccgtaaagccattgacctgctggtagcgtgggggctggtggtccgccgccacggtagtggcacttacctggtgcgcaaagatgtactgcatcaaaccgccagtctgaccgggctggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctgatgctggaagacagctatatgccggtaaaactgttccgtaatctttcgctgcaacatctggaagggtcgaagtttgaatatattgaacaagagtgcgggattttgattggcggtaattatgaaagcctgacgccagtgctcgccgatagactgctggcgcggcaaatgaaggtagcggaacacacgccactgctgcggatcacctcgttgtcatatagcgagagcggggagtttttgaattattcagtgatgttcagaaatgccagcgaataccaggtggagtaccatttacggcgactccacccggaaaagagttaa

SEQ ID NO: 424 - protein, 238 aa, Escherichia coli [sequence omitted]

SEQ ID NO: 425 - DNA, 732 bp, Bacillus subtilis
  CDS (1)..(732)
atgaatatcaataaacaatcgcctattccgatttactatcagattatggagcaattaaaaacccaaattaagaacggagagctgcagccggatatgcctcttccttctgagcgcgaatatgccgaacaattcgggatcagccggatgacagttcgccaggcgctttctaatttagttaatgaaggcttgctctatcgcctgaaagggcggggcacctttgtcagcaagccaaaaatggaacaagcacttcaagggctgacaagctttaccgaggatatgaaaagccgcgggatgacaccgggcagcaggctcattgattatcagcttattgattcaactgaggagctcgcggctatattaggctgcgggcacccctcctctatccataaaatcactcgggtgcggctggcaaatgatattccgatggcgattgagtcctcacatattccgtttgagcttgcgggtgaattgaacgaatcgcattttcagtcgtcgatctatgatcatattgaaaggtacaacagcataccgatttcccgtgcaaaacaggagcttgagccaagcgctgccaccacggaagaagcgaatattcttggtattcaaaagggagcgcctgtcctattaattaaacgaacaacatatctgcagaacggaactgcttttgagcatgcaaaatccgtatacagaggcgaccgttatacatttgtccactatatggatcgtctttcataa

SEQ ID NO: 426 - protein, 243 aa, Bacillus subtilis
MNINKQSPIPIYYQIMEQLKTQIKNGELQPDMPLPSEREYAEQFGISRMTVRQALSNLVNEGLLYRLKGRGTFVSKPKMEQALQGLTSFTEDMKSRGMTPGSRLIDYQLIDSTEELAAILGCGHPSSIHKITRVRLANDIPMAIESSHIPFELAGELNESHFQSSIYDHIERYNSIPISRAKQELEPSAATTEEANILGIQKGAPVLLIKRTTYLQNGTAFEHAKSVYRGDRYTFVHYMDRLS

SEQ ID NO: 427 - DNA, 714 bp, Bacillus halodurans
  CDS (1)..(714)
atgaatgttaaaaaaagacctttatataaacagcttaaacaggaattaattcaaaaaattgaaagaggagagttaaaaccaggtgatgtattacctcctgaaagagaacttgcaaagatatttaatatgagtcgtatgacggttagacaagcgatttctgaacttgttaatgaatacgttcttattaggcgacatggtagtggaacatatgtggctgaacataaaattccacaagggaaaaaattaaaaagctttagtgaggagatgcgtttaagaggaatgttgcctgggtctaaactttgtgagaaaaaaattgttttaagcccttcagcgaacatggcggctgaactaaaatcagagggaaagctattcatgttaaaacgtttacggttagcagatctcgagcctatggcgatagagacaagtttgcttccgattaatagattccctagccttgaaaatagaaattttgaaaatgagtcactctatgaaatattagaggaagaatacaatattaaaatgacaaaggctcaacaaaaaattgaagtgagaatgccgacacctcaggaatcagaattacttgatataaattacacgataccagtttttcattttaaacaggtaacttttgatcaaaatgatactatttttgaggttgcccattcagtttataggggggaccgatatgaaatagagacggaaatctatcgctga

SEQ ID NO: 428 - protein, 237 aa, Bacillus halodurans
MNVKKRPLYKQLKQELIQKIERGELKPGDVLPPERELAKIFNMSRMTVRQAISELVNEYVLIRRHGSGTYVAEHKIPQGKKLKSFSEEMRLRGMLPGSKLCEKKIVLSPSANMAAELKSEGKLFMLKRLRLADLEPMAIETSLLPINRFPSLENRNFENESLYEILEEEYNIKMTKAQQKIEVRMPTPQESELLDINYTIPVFHFKQVTFDQNDTIFEVAHSVYRGDRYEIETEIYR

SEQ ID NO: 429 - DNA, 729 bp, Listeria monocytogenes
  CDS (1)..(729)
atggctcagaaccagacaaaatatagctttattgctgaagaaatccgcaaaagaattatgaatcacgcctatccgctaaatcaacctattcctgatgagataactttggcgaaagagtttgattgtagtcgaatgacaatgaaaaaagcgcttgaagtacttgtacttgaaggcttactataccggaaacgtggacatggtactttcattatcaaatcggcgctggacgcggaccgcttgcagattcataaccaagaggtaaacggcttcactaaacttttgaatggtaagaaagttattagtaaagtaatcgagtttaaagtcatttttccaaccgaagaaattgcagagcgccttcatatcgaaatggaaacgccaatctatgatattcttcgtgttcggctagtgaaagatgaaccatatgtattagaacacacgtatatgccggttggggttatcccaggcatcaatcagcaaattttggaaggatcgatttattcgtatattcaagatgatttgaacctaaaaatcgctagttcgtacaaacaaattcgcgcggataaagcgacgctgcttgatcagcaatatctcgactgcgcttctgatgacccagttgttgaagtagaacaaaccgtgtatttaaacaatggtctcgcgtttgaattttccagatcgcgccaccgttatgataaattcgtttttactaccgtgaatatcgctagacgataa

SEQ ID NO: 430 - protein, 242 aa, Listeria monocytogenes
MAQNQTKYSFIAEEIRKRIMNHAYPLNQPIPDEITLAKEFDCSRMTMKKALEVLVLEGLLYRKRGHGTFIIKSALDADRLQIHNQEVNGFTKLLNGKKVISKVIEFKVIFPTEEIAERLHIEMETPIYDILRVRLVKDEPYVLEHTYMPVGVIPGINQQILEGSIYSYIQDDLNLKIASSYKQIRADKATLLDQQYLDCASDDPVVEVEQTVYLNNGLAFEFSRSRHRYDKFVFTTVNIARR

SEQ ID NO: 431 - DNA, 729 bp, Listeria innocua
  CDS (1)..(729)
atggctcagaaccagacaaaatatagctttattgctgaagaaatccgcaaaagaattatgaatcacgcctatccgcttaatcaacctattcctgatgagataactttggcgaaagagtttgattgtagtcgaatgacaatgaaaaaggcgcttgaagtacttgtacttgaaggcttactatatcgtaaacgcgggcatggtactttcattatcaaatcggcgctggacgcggaccgtttgcagattcataaccaagaagtaaatggtttcactaaacttttagacggaaaaaaggtcattagcaaagtaattgagtttaaagtcatctttccaacagaagaaattgcggaacgtcttcatatcgaaatggaaacgccaatctatgatattcttcgtgttcggctagtgaaagatgaaccgtatgtgctagaacatacgtatatgccggttggggttatcccaggcattaaccagcaaattttagaaggttcgatttactcatatattcaagacgatttgaacctaaaaattgctagttcgtacaaacaaattcgcgcggataaagcgacactgcttgatcagcaatatctcgactgcgcttctgatgaccccgttgtcgaagtagaacaaaccgtttatttaaacaacggtctcgcgtttgagttttccagatcgcgtcaccgttatgataaattcgtgtttactaccgttaatattgctagacgttaa

SEQ ID NO: 432 - protein, 242 aa, Listeria innocua
MAQNQTKYSFIAEEIRKRIMNHAYPLNQPIPDEITLAKEFDCSRMTMKKALEVLVLEGLLYRKRGHGTFIIKSALDADRLQIHNQEVNGFTKLLDGKKVISKVIEFKVIFPTEEIAERLHIEMETPIYDILRVRLVKDEPYVLEHTYMPVGVIPGINQQILEGSIYSYIQDDLNLKIASSYKQIRADKATLLDQQYLDCASDDPVVEVEQTVYLNNGLAFEFSRSRHRYDKFVFTTVNIARR

SEQ ID NO: 433 - DNA, 723 bp, Bacillus halodurans
  CDS (1)..(723)
atgattaataaaaactctcctttaccgatttattatcagattgaagaacaaattaagcagcaaatcgaatcaggggtgctcaaacccggggatatgctcaaatccgagcgggagtatgcggagtattatgatgtcagtagaatgacggtaaggcaagcgattaacaaccttgtgaatcaaggatacatatataagaaaaaaggtagcggtacttatgttcaagagaaaaaaattgagcaggcgttaaacgggctgacgagttttacagaagatatgagaaaaagaggaatggagcctagcagtcgcttgctcaaatttgaactgattccagcaacggcaaaaatcgcaaaggaattaaacttgaaagagaacacgcccgttacagagattaaacgaatccgttatggtgatggggtaccaattgccattgaacgcaacctgttgcctgcgaacttagtgaagggattaaatgaggaaatcataaaccaatccttatatcaatacattgaggaagagttgaatttgcggatcgccgatgccctacaagtgattgaagcctcgactgctagcaaaacagaagccgatctattagagattcaaaaaggtagcccgattttgttaattgagcgtaaaacgtttttagccgatgggactgtattagagctagtgaaatccgcttaccgagccgatcggtataaatttatgattacgatgcaacgataa

SEQ ID NO: 434 - protein, 240 aa, Bacillus halodurans
MINKNSPLPIYYQIEEQIKQQIESGVLKPGDMLKSEREYAEYYDVSRMTVRQAINNLVNQGYIYKKKGSGTYVQEKKIEQALNGLTSFTEDMRKRGMEPSSRLLKFELIPATAKIAKELNLKENTPVTEIKRIRYGDGVPIAIERNLLPANLVKGLNEEIINQSLYQYIEEELNLRIADALQVIEASTASKTEADLLEIQKGSPILLIERKTFLADGTVLELVKSAYRADRYKFMITMQR

SEQ ID NO: 435 - DNA, 711 bp, Streptococcus pneumoniae
  CDS (1)..(711)
atgaagaaataccaacaattatttaagcaaatccaagaaaccattcaaaacgagacttacgctgtcggagattttcttcctagcgagcacgaccttatggagcaatatcaagtgagtcgtgataccgtccgaaaggccctgtctctcctccaagaggaaggattgatcaaaaagataagagggcaaggttctcaagtcgtcaaagaagaaaccgtcaatttccctgtatccaacctaaccagctaccaagaactagttaaagaacttggactgcgctctaaaaccaacgtggtcagtctggacaagattattattgataaaaaatcctcactgataaccggtttcccagagtttcggatggtttggaaggtggtccgccagcgtgtggtggatgatctggtatccgttctggatacggactatctggatatggaactaatcccaaatctcactcgccaaatcgctgagcagtctatctattcttatatagaaaatggcctcaaactccttattgattatgctcagaaggaaatcaccattgaccactcaagcgaccgagacaagattctcatggacattggcaaagacccttatgtcgtttcgattaaatcaaaagtctatctccaagacggacgccaatttcagtttaccgaaagtcgccataagttagaaaaatttagatttgtagattttgcaaaacgcaagaaataa

SEQ ID NO: 436 - protein, 236 aa, Streptococcus pneumoniae
MKKYQQLFKQIQETIQNETYAVGDFLPSEHDLMEQYQVSRDTVRKALSLLQEEGLIKKIRGQGSQVVKEETVNFPVSNLTSYQELVKELGLRSKTNVVSLDKIIIDKKSSLITGFPEFRMVWKVVRQRVVDDLVSVLDTDYLDMELIPNLTRQIAEQSIYSYIENGLKLLIDYAQKEITIDHSSDRDKILMDIGKDPYVVSIKSKVYLQDGRQFQFTESRHKLEKFRFVDFAKRKK

SEQ ID NO: 437 - DNA, 729 bp, Streptococcus pneumoniae
  CDS (1)..(729)
atgagtacaaaatatttatttatttacaatgagattcgtgaaaagattctttgtaataaatataccatgaacgaacaattgcctgatgaaatgacattagctaaacagtttgcctgtagtcgaatgacgatcaaaaaagctttagacttgttagtttctgagggcttaatttttagaaaacgtgggcagggaacctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttacgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcctcctaa

SEQ ID NO: 438 - protein, 242 aa, Streptococcus pneumoniae
MSTKYLFIYNEIREKILCNKYTMNEQLPDEMTLAKQFACSRMTIKKALDLLVSEGLIFRKRGQGTFVLSRGSSKRKLIVPERDIRGLTKISEDAHSTIDSRIIHFKLEFANEFLAEKLQVALQSPVYNIYRLRIIDGKPYVLEQTYMSTDVIPGITEDILQKSIYNYIEGKLGLHIASATKILRASSSSENEQHYLQLLPTEPVFEVEQVAYLDNGTPFEYSISRHRYDLFEFNSFALRHSS

SEQ ID NO: 439 - DNA, 756 bp, Escherichia coli
  CDS (1)..(756)
atgcgcgccatgaaatcattaagtaagtcgtcacaaataccgctctatcaacaagtggtggagtggataagagaaagtatttataccggagatctggtggaagacgatcgcattccttcggaataccagattatggatatgctggacgtgagtcggggaaccgttaaaaaagcggtcgcccaactggtaaaagaaggcgtgttaatacaggtccagggtaagggaacatttgtcaaaaaagagaacgtggcatatccgttaggtgaaggattattgtcattcgcggaatcgctggaaagccagaaaatacattttaccactgaagttattacgtcacggattgaatcggctaatcgttatgtggcagagaaattaagaataacgcccggtcaggatattctttaccttgaacgcttacgctcaattggtgatgaaaaagcgatgctgatagagaaccgtatcaatattgagctatgccccggtattgctgaaatcgattttaatcaacacaatttatttccaacaatagaaagtttgtcgcaaagaaaaattcgttactcggaaagtcgctatgccgcgcgattaattggtaatgaacgtggtcattttttagatatcagtgaagacgcacccgttttgcatctggagcagttagtctttttctcccgaggattacccattgagtttggcaacgtctggttaaaaggaaataaatattatcttggcaccgtactgcaacggcgggaagtgagttaa

SEQ ID NO: 440 - protein, 251 aa, Escherichia coli
MRAMKSLSKSSQIPLYQQVVEWIRESIYTGDLVEDDRIPSEYQIMDMLDVSRGTVKKAVAQLVKEGVLIQVQGKGTFVKKENVAYPLGEGLLSFAESLESQKIHFTTEVITSRIESANRYVAEKLRITPGQDILYLERLRSIGDEKAMLIENRINIELCPGIAEIDFNQHNLFPTIESLSQRKIRYSESRYAARLIGNERGHFLDISEDAPVLHLEQLVFFSRGLPIEFGNVWLKGNKYYLGTVLQRREVS

SEQ ID NO: 441 - DNA, 744 bp, Caulobacter crescentus
  CDS (1)..(744)
atgacgtttgcggaacgaatcggccgtctcgacgccacgggcgatcacgccccgctgtaccggcagctgcagcgcgcgctgcgcgaagccatccagaagaaggtgctggctccggacgacgcccttcccgccgagcgggacatggcggacgaattcaacatctcgcgcatcaccgttcgcaaggcgctggacggcctggtcagcgagggcctgctgacgcgccgccaaggcgccgggacctttgtcgccgcgcgggtcgagaagagcttctccaagctgtcctcgttcaccgaggacatgatctctcgcggccgcgtcccgcgcagcgagtggatcagccgcagcgagggccaggtgacccccgaggagtcgctgaccctgggcctgtcgcccggaaccccggtctatcggttcgcacggatccgctatgcggacggcgcgccgatggcggtggaatacacaacgatcgcggccttcgccctgccctccaccgaagtggtcggcacatcgctctatgaagcgctggagacgaccggtcaccgcccggtgcgcgcgctccagcggctgcgcgcggtgctgttccaggccgagcaggcggacctgctgggcgtgcccgtcaaggacgccggcctgctgatcgagcggcgaggcttcctgaaggacgggcgggccgtcgaggtcacgcaatcctactaccgcggcgacgcctacgacttcgtcgccgaactgaattccctgtcctaa

SEQ ID NO: 442 - protein, 247 aa, Caulobacter crescentus
MTFAERIGRLDATGDHAPLYRQLQRALREAIQKKVLAPDDALPAERDMADEFNISRITVRKALDGLVSEGLLTRRQGAGTFVAARVEKSFSKLSSFTEDMISRGRVPRSEWISRSEGQVTPEESLTLGLSPGTPVYRFARIRYADGAPMAVEYTTIAAFALPSTEVVGTSLYEALETTGHRPVRALQRLRAVLFQAEQADLLGVPVKDAGLLIERRGFLKDGRAVEVTQSYYRGDAYDFVAELNSLS

SEQ ID NO: 443 - DNA, 708 bp, Lactococcus lactis subsp. lactis
  CDS (1)..(708)
atggcaagaaaatcagtaccgaattatgtaaaaatacatgatgccttaaaagatgaagttgaaaaaggcatctggaaaattggacaacgtcttccaagcgaacgtgatttggccgagcgttttactgtcagtcgaatgacagcaagacaagcggtaacagctttggttgatgaaggaattcttgaccgtcgtgtgggttctggaacttatgttgctagccgacgtgttcgcgaaaaaatgcgtggaacaacttcctttacagaaattatcagctcacaaggtaaagttccttcaacagaagttttgagttatattagaacggcgccaaatgaggttgaatgtgaaaaactaaatatcaccaaaaaggattccatcatccgaatggagcggattcgttatgcggataatgttccaatttgttatgaagtggcaagcattcctttcaaattggtcaaatcttttgataaaaaagaaattactagtaacttctttaaaactttagaaagtcacggacatgtgattggtcgtagtgaacagattgtttcagctaaaagagtcagtacagaggtttcagagtatttaaaaacaagagttggagctgctattcttggtttaactcaggtttcttatttaacagatggtacagcttttgaatatgtcttatctcaatatgttggtgaccgttttgaattttatttggaaagataa

SEQ ID NO: 444 - protein, 235 aa, Lactococcus lactis subsp. lactis
MARKSVPNYVKIHDALKDEVEKGIWKIGQRLPSERDLAERFTVSRMTARQAVTALVDEGILDRRVGSGTYVASRRVREKMRGTTSFTEIISSQGKVPSTEVLSYIRTAPNEVECEKLNITKKDSIIRMERIRYADNVPICYEVASIPFKLVKSFDKKEITSNFFKTLESHGHVIGRSEQIVSAKRVSTEVSEYLKTRVGAAILGLTQVSYLTDGTAFEYVLSQYVGDRFEFYLER

SEQ ID NO: 445 - DNA, 747 bp, Bacillus halodurans
  CDS (1)..(747)
atgaataaaaaaaacattgatcaatctctacactcctatgttaaaaatgagttagttaacgccatacaacaaggggtttatccagttaaatctcaattgccgacagaggctgaactatgccaaatgtacgacgttagtcgaacaacgattcgaaatgcattacaacaactcgtaatcgatggctatgtagagagaattcaaggaaaaggaaccttcgtcgcaagccgcagagtaaagcaaacgttatctgcaaccgaaggaaattatagtgaacagctacgcctgcaagggaaaaaaccgaaaatacaagtaattgatttaactgttgttccatctgatgagcttttgtcggctatgctggaaattgacgaaaatgaacctgtccaccgccttgaacgtattcgttatgcagacgacgcccctctacaatatgaaatttcttatttgccttggcgcaaaacgacttggttaacgaaagaaggctgtgaacactctctctatcaattgctgcaaagtcatcctgatctatcattagcaaagacgaaagagcatttgcatatcgtcctcgctgatgaagaagtcgctgaaaagctatcaatctctattggagatccttgtattcaaattgaaacccatgcgtacttagcggacgatacaaagatcgagtattccattgcttattttcacggtgaaaaggcgagctttacgatcgaacgaaactaccaaaaaccgactcagacgtcataa

SEQ ID NO: 446 - protein, 248 aa, Bacillus halodurans
MNKKNIDQSLHSYVKNELVNAIQQGVYPVKSQLPTEAELCQMYDVSRTTIRNALQQLVIDGYVERIQGKGTFVASRRVKQTLSATEGNYSEQLRLQGKKPKIQVIDLTVVPSDELLSAMLEIDENEPVHRLERIRYADDAPLQYEISYLPWRKTTWLTKEGCEHSLYQLLQSHPDLSLAKTKEHLHIVLADEEVAEKLSISIGDPCIQIETHAYLADDTKIEYSIAYFHGEKASFTIERNYQKPTQTS

SEQ ID NO: 447 - DNA, 732 bp, Clostridium acetobutylicum
  CDS (1)..(732)
atgaagatagtatcaaaatcaagtcctcttcctcttcattatcagctcaagatgattttacaggaaatgatcgaaaatgaagaattgcttcctggagatactattcctactgaaagagaactttgtgaaatccagaaaataagtagaatgactgtaaataaagcaattctatcattagtgtctgaaggtattctctatagggagcaaggtaagggaacctttgtagccaaaaaaaaggagaaacaacaactgacaaagctaaagagttttactgaagaaatgagggaaaagggcctaaacataagtacaaaaatactatcctttgaaataaaaactgccacaaaacatataagcaccttattggaacttccacataagaaaatgaaagttatagaaataatacgtcttagattaacagataatgatccctctgcaatagaaactgttgtacttcccttgtatttatttagtgatatgacaaaagaagttattgatgggaaatctctatacaatacctttagagagaaatatggctatgagcctacaaaggcaaaacaaactattgaacctatcatgctaacagactatgaggcaaaattcttaaatcaagtaggtaattccttagcccttctttttcgaagactcacctatagaaaggatggagttcctattgaatacacaaaatcaatatatagaagtgaaaaatataaatatgaagtaatattaacttaa

SEQ ID NO: 448 - protein, 243 aa, Clostridium acetobutylicum
MKIVSKSSPLPLHYQLKMILQEMIENEELLPGDTIPTERELCEIQKISRMTVNKAILSLVSEGILYREQGKGTFVAKKKEKQQLTKLKSFTEEMREKGLNISTKILSFEIKTATKHISTLLELPHKKMKVIEIIRLRLTDNDPSAIETVVLPLYLFSDMTKEVIDGKSLYNTFREKYGYEPTKAKQTIEPIMLTDYEAKFLNQVGNSLALLFRRLTYRKDGVPIEYTKSIYRSEKYKYEVILT

SEQ ID NO: 449 - DNA, 708 bp, Streptococcus pneumoniae
  CDS (1)..(708)
atgaaaaatatgctacctgcttatatgaaaatccatgatcagataaaaaaggatattgacgagcaccgttgggctattggtgagaggcttcccagtgaaagagatttagctgagcagtttgcggtcagtcgcatgaccctccgccaagccgtatctctattagtcgaagaaggcgtcttagagcgccgtgtaggaagcggcacctttgtttccagtactcgagtacaagaaaagatgcgagggacaaccagttttactgaaattgtcaaatcccaaggtaaagttccctctagccagctcatttcctacaaaaaaaccattcccaatgagcaagaagttgccaagctaggaatttttccaacggacaatattatccgaatggagcgggtccgctatgccgaccaagttcccctagtttatgaagttgcttctattcctgaaaaattcattaaggactttaaaaaagaagaaatcaccagtcatttcttccaaaccttgcaaaaacatggctatcgtatcggtaaatcccaacagaccatctatgctcgccttgctaaagaaaagattgcccactatttggaagttgaaaaaggacatgctattcttggattgacccagatttcctacctagaagatggtactgcttttgaatacgtaaaaagtcaatatgtaggcgaacgctttgaattttatcttgaaaataattaa

SEQ ID NO: 450 - protein, 235 aa, Streptococcus pneumoniae
MKNMLPAYMKIHDQIKKDIDEHRWAIGERLPSERDLAEQFAVSRMTLRQAVSLLVEEGVLERRVGSGTFVSSTRVQEKMRGTTSFTEIVKSQGKVPSSQLISYKKTIPNEQEVAKLGIFPTDNIIRMERVRYADQVPLVYEVASIPEKFIKDFKKEEITSHFFQTLQKHGYRIGKSQQTIYARLAKEKIAHYLEVEKGHAILGLTQISYLEDGTAFEYVKSQYVGERFEFYLENN

SEQ ID NO: 451 - DNA, 798 bp, Yersinia pestis
  CDS (1)..(798)
atgccgggtggaatgggtggaaagggtgtggacagaaaattcatcgagacactgaaaacatactgtgatgatgctaaccggggagggggtccgctctaccagcgtctggagaaaggtttccgcgatctgatcacccgtggtgagctaaaagccggatacgcgattcccagcgaacgcgaactttcggaacgcttgaatctgtccagagtgacagtccggcgtgcgttaagtgaactggctaacgcgcaggttatcgtgcagcgtcgtggagcgagaagtactgtggcgggaagggttgaaaagccgctgtcttcgctgaccagctttagtgaggatatgatttcacgtggctatgagccaggcgcacgctggctacagaaagagcttactcacgcttctccctcggaaattattgcactgaatctgtctccaggtgctctggtgtggcgtctcaagcgcctgcgtaccgtagatgaacacccgatggcagtggagatcgccgtggtgccgcagatgtttattccagagatggatgaactgagggattcgctttattcagtactgcagttgcacgggtttatgcccgcccgcgcgttacagcgtattcgagcagaaccgctgagtcgcgatcacagccaactgttagatatgcctgctcacagcccggcgctgcatgttgagcgccattgctatctggaagatggccgcccgattgaatacacccatacctggtatcggggcgacagttacgattttctggttgaacttcagcgcgacatcacccccggtctgtcataa

SEQ ID NO: 452 - protein, 265 aa, Yersinia pestis
MPGGMGGKGVDRKFIETLKTYCDDANRGGGPLYQRLEKGFRDLITRGELKAGYAIPSERELSERLNLSRVTVRRALSELANAQVIVQRRGARSTVAGRVEKPLSSLTSFSEDMISRGYEPGARWLQKELTHASPSEIIALNLSPGALVWRLKRLRTVDEHPMAVEIAVVPQMFIPEMDELRDSLYSVLQLHGFMPARALQRIRAEPLSRDHSQLLDMPAHSPALHVERHCYLEDGRPIEYTHTWYRGDSYDFLVELQRDITPGLS

SEQ ID NO: 453 - DNA, 723 bp, Listeria innocua
  CDS (1)..(723)
atgatcgataaacaatcaggaataccgatttacattcagattcaaagtgaaattaaaaagaaaatggaagatggtgtctggaaagttggcacttctattccagctgaacgtcaacttgctgaaatgtttcacgttagtcgaatgacagtaagacaagccattcaaggactagtcgatgataatattttgcaaagacgcgttggcgctgggacttttattgcggaaaagaaattaaccgaacgactagaagctgtcacaagttttacgaatttgatgttgcaagaagggaaagttccttcaacgcgtatcgtatcgtatggcattcgtccggcaagtacgcaagaacaagaagcgttacaactaccagaaaacagcaatgtaatgaaaattgaacggattcgttacggcgaccgtgtaccaattctttatgaagttgccgccattccagaaaaaattgcttcactgcttacaaaggaagacattatggattccctttataaagcgattgaattaaaacttggtcaaaaaatcggagaagcagaacaaacgatggaagcttctttagtatcagaaaaaattgcgccatatcttgatgtgaaactcggatcaccggttatgaaacttcggcagattacaactttagaagatggtcgaccatttgaatttacacgttctcaatatgtaggtagtagatttcaatttgtagctaggattaaacaataa

SEQ ID NO: 454 - protein, 240 aa, Listeria innocua
MIDKQSGIPIYIQIQSEIKKKMEDGVWKVGTSIPAERQLAEMFHVSRMTVRQAIQGLVDDNILQRRVGAGTFIAEKKLTERLEAVTSFTNLMLQEGKVPSTRIVSYGIRPASTQEQEALQLPENSNVMKIERIRYGDRVPILYEVAAIPEKIASLLTKEDIMDSLYKAIELKLGQKIGEAEQTMEASLVSEKIAPYLDVKLGSPVMKLRQITTLEDGRPFEFTRSQYVGSRFQFVARIKQ

SEQ ID NO: 455 - DNA, 714 bp, Listeria innocua
  CDS (1)..(714)
atggttaagtatgaactgattgccgcagaaatccgtgaaaaaataaacaacggtacttatccaccagaatccattcttcctgatcaagtgagcttatctagagcttatgattgtagcagaatgacaataaaaaaagcctttgacgtacttgcgcttgaaggacttgtttacagacaacgtggtgcaggaacttttgtgatgaaaaatgccttagctaataaacaagatgcgagtttgcgagattatgacggtctaacaaaaatgatgggagacaatcgaatccgaagtaaaatcattgcattcgatattgctttcccagatgaaaaaacgcaagaacaactcttgattaaagcagaccaaccagtgtataaattgattcgtttgcgcctgttagatggtgagccgtatgtattagagcatacaaccatgccagcagatttagttccaggtttaacgagagagattttgcatcattctatttatgcatacttacaagacacactagggctcgttttaagtggtgcatttcgaaaaattaatgccgataagccatctgaatatgaccaagaatatttagcgtgcggagaacatgatccagttttagaagtggagcaagtagtgtatttaaaagacggtagaccagtcgaatattcccgttcaagacatcgctatgatacgagaagtttcattatggttgatcaccgagaaaagtaa

SEQ ID NO: 456 - protein, 237 aa, Listeria innocua
MVKYELIAAEIREKINNGTYPPESILPDQVSLSRAYDCSRMTIKKAFDVLALEGLVYRQRGAGTFVMKNALANKQDASLRDYDGLTKMMGDNRIRSKIIAFDIAFPDEKTQEQLLIKADQPVYKLIRLRLLDGEPYVLEHTTMPADLVPGLTREILHHSIYAYLQDTLGLVLSGAFRKINADKPSEYDQEYLACGEHDPVLEVEQVVYLKDGRPVEYSRSRHRYDTRSFIMVDHREK

SEQ ID NO: 457 - DNA, 723 bp, Listeria monocytogenes
  CDS (1)..(723)
atgatcgataaacaatcaggaataccgatttacattcagattcaaagtgaaattaaaaagaaaatggaagatggtgtctggaaagttggcacttctattccagctgaacgtcagcttgcagaaatgttccacgtcagccgaatgacggtaagacaagccattcaaggcctcgttgatgataacattttgcaaaggcgtgttggtgccgggacttttattgcggaaaagaaactaaccgaacgacttgaagcggttacgagttttacgaatttgatgttacaagaggggaaagttccttcgacgcgaatcgtatcgtacggtattcgtccggcaagtacgcaagaacaagaggcgttgcaactaccagaaaacagcaatgtaatgaaaattgagcggattcgttatggcgaccgcgttccaattctttatgaagttgcggccattccagaaaaaattgcttcactgcttacaaaggaagacattatggattccctttataaagcgattgaattaaaacttggtcaaccaattggagaagcggaacaaatcatggaagcttctttagtatcagaaaaaattgcgccatatcttgatgtgaaactcggatcaccggttatgaaacttaggcaaattacaacgttagaagacggtcgaccatttgaatttacgcgttcccagtatgtaggtagtagatttcaatttgtagctaggattaaacaataa

SEQ ID NO: 458 - protein, 240 aa, Listeria monocytogenes
MIDKQSGIPIYIQIQSEIKKKMEDGVWKVGTSIPAERQLAEMFHVSRMTVRQAIQGLVDDNILQRRVGAGTFIAEKKLTERLEAVTSFTNLMLQEGKVPSTRIVSYGIRPASTQEQEALQLPENSNVMKIERIRYGDRVPILYEVAAIPEKIASLLTKEDIMDSLYKAIELKLGQPIGEAEQIMEASLVSEKIAPYLDVKLGSPVMKLRQITTLEDGRPFEFTRSQYVGSRFQFVARIKQ

SEQ ID NO: 459 - DNA, 744 bp, Salmonella enterica subsp. enterica serovar Typhi
  CDS (1)..(744)
atgaaaacattgagtaaaagttcacacatcccactgtatcaacaggttgtggagtggataagggaaagtatttatagcggagaattagttgaggatgaccggataccttcagagtttcaaatcatggatatgctggaggtgagtcgcggtaccgttaaaaaagcggttgaccaacttgtccgggaaggtgttcttgtgcaagtgcagggtaaaggaactttcgtaaagaaggaaaatgttgcttacccactgggtgaaggtttgctctcctttgctgaagccttagccagccagaagataaacttcacaaccagtgtcataacctcccgactggaacccgctaaccgctttgtagcagagaaactgagtatcaaaccgggacaagatgttttatttcttaaacgccttcgttgtattggcgatgaaaaagtcatgttgattgaaaatcgtatcaacattgatctctgccccggtattattgatgtagattttaccagggagaatttattttcagcaatagaaagattatctgataagaaaataagtttttctgaaagccgttacgcagccaaattaattggtaatgagcgaggccattatcttgatattggtgaagacgcacctgttttgcatttggaacagttggtatttttctctagaggattggccattgattttggtaacgtctggttaaaaggtaataaatattatcttggcactattttacagcgcctggatgcctaa

SEQ ID NO: 460 - protein, 247 aa, Salmonella enterica subsp. enterica serovar Typhi
MKTLSKSSHIPLYQQVVEWIRESIYSGELVEDDRIPSEFQIMDMLEVSRGTVKKAVDQLVREGVLVQVQGKGTFVKKENVAYPLGEGLLSFAEALASQKINFTTSVITSRLEPANRFVAEKLSIKPGQDVLFLKRLRCIGDEKVMLIENRINIDLCPGIIDVDFTRENLFSAIERLSDKKISFSESRYAAKLIGNERGHYLDIGEDAPVLHLEQLVFFSRGLAIDFGNVWLKGNKYYLGTILQRLDA

SEQ ID NO: 461 - DNA, 810 bp, Corynebacterium glutamicum Brevibacterium flavum
  CDS (1)..(810)
atgaacaccatgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgctttggaaatggtcgaccctatgccattgacaacggttggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctggacgtcacccccggcgccccactccttcgtatccttcgacagtcactttctggcgataagcccgtggaatggtgcgtttccttgtaccgaaccgaccgatattctttaaaaacattggttacacgctccgaagatctctaa

SEQ ID NO: 462 - protein, 269 aa, Corynebacterium glutamicum Brevibacterium flavum
MNTMPDQPLNQDGFPTASKGVEPDNLPDRVLVDGLKPKHQQLREILEEICTTQLQPGDMLPGERILEEKYGVSRITVRRAIGDLVASGRLKRARGKGTFVAHSPLISRLHLASFSAEMAAQKLSATSRILSSSRGPAPDDIADFFGTDRAAQHITLRRLRFGNGRPYAIDNGWYNSEFAPDLLENDVYNSVYSILDRVYGVPVTQAEQTVTAVAADEDTARLLDVTPGAPLLRILRQSLSGDKPVEWCVSLYRTDRYSLKTLVTRSEDL

SEQ ID NO: 463 - DNA, 705 bp, Pseudomonas fluorescens
  CDS (1)..(705)
atgagcaaatacaaccagatctatacggatctgcttgccagcatcaccaccgaacgcctgcaacgcggcacgcgccttccctctgaaaccgaattgatggacgcctaccaggccagccgtggcaccgtgcgtcgggccatcgagcaattgcaagagcgtgggttcgcgcaaaagatccatggcaagggcacgttcgtgctgtcccccaacccgattgagttccaactggggggcattgtcagcttccacgaaacccacgccgacctgggcgatgacgtacgtaccgaagtggtcgaattcactcaactgcccctggaaggctccctgcagcagcatatcgaggccgagcccggcaccctgatcacgcgcatcaagcgagtgcggcgcatcggcggcaaacgggtgatcctcgacatcaaccgcttcgtcgccgacctgatcccgggcctggaccagacgattgccgaacagtcgatctacgcgtttatcgagcagacgctgcaactgcagatcagctacgcccagcgcaccatcgaagccctgccccgcagcaaggacgaccaggcgcacttggacctcgacggccagagccatgtgattgtggtgagtaaccagacgtttttgcaggatgggcggcagttcgagtacaccgagtcgcggcatacattggataagttttacttttcggatattgcgcggcgctaa

SEQ ID NO: 464 - protein, 234 aa, Pseudomonas fluorescens
MSKYNQIYTDLLASITTERLQRGTRLPSETELMDAYQASRGTVRRAIEQLQERGFAQKIHGKGTFVLSPNPIEFQLGGIVSFHETHADLGDDVRTEVVEFTQLPLEGSLQQHIEAEPGTLITRIKRVRRIGGKRVILDINRFVADLIPGLDQTIAEQSIYAFIEQTLQLQISYAQRTIEALPRSKDDQAHLDLDGQSHVIVVSNQTFLQDGRQFEYTESRHTLDKFYFSDIARR

SEQ ID NO: 465 - DNA, 762 bp, Streptomyces griseus
  CDS (1)..(762)
atgggcgccgaaggggcagtacggggggcgagaccggtaccggtacgcgcacagcgcgtaccgaagtactaccggctcaagcgccatctcctcgacatgacggacaccctgccgcccggcacccccgtgccgcccgaacgcaccctggcggccgaattcgacacctcgcgcaccaccgtgccgcaggcgctccaggagctggtcgtggagggccggctggagcgcatccagggcaagggcaccttcgtggccaagccgaaggtctcccaggccctccagctcacctcgtacaccgaggacatgcgtgcccagggactggagccgacgtcccaactgctggacatcggctatgtgacggcggacgacacgctcgccggcctgctggacatctcgacgggcggccgggtgctgcgcatcgagcggctgcggctcgccagcggggagccgatggcgatcgagaccacgcacctttcggccaaacgcttcccggcgctgcgccgttcgctggtgaagtacacctcgctctacaccgcgctcgccgaggtgtacgacgtgcgcctcgccgaggcggaggagaccatcgagacctcgctcgcgacgccgcgcgaggcgggactgctcggcaccgacgtggggctgccgatgctcatgctgtcccgccattcggtggacggccagggcgaacccgtggagtgggtgcgatcggtgtaccggggcgaccggtacaagttcgtggcccgcctgaagcggggcacggactaa

SEQ ID NO: 466 - protein, 253 aa, Streptomyces griseus
MGAEGAVRGARPVPVRAQRVPKYYRLKRHLLDMTDTLPPGTPVPPERTLAAEFDTSRTTVPQALQELVVEGRLERIQGKGTFVAKPKVSQALQLTSYTEDMRAQGLEPTSQLLDIGYVTADDTLAGLLDISTGGRVLRIERLRLASGEPMAIETTHLSAKRFPALRRSLVKYTSLYTALAEVYDVRLAEAEETIETSLATPREAGLLGTDVGLPMLMLSRHSVDGQGEPVEWVRSVYRGDRYKFVARLKRGTD

SEQ ID NO: 467 - DNA, 765 bp, Streptomyces sp 139
  CDS (1)..(765)
atgagtacggacgtcagcagcgccggggccgacacgagggcgccgggccgccgggaccgcgtgccgaagtactacctcatcaagcagcggctgctgcagatgaccgacgagcgcgcgccgggctccccgatgccggccgagcggctgctcgccgtcgagttcggcacgtcccgcaccaccgtccgcaaggcactgctggaactggtgagcgagggccggctcgaccgcatccagggcaagggcaccttcgtggcccggccgaaggtgtatcggacactccaactgacctcgtacaccgaggacatgcgcgcccaggggctcagccccgcctcgcaggtcctggacatcggatacgtcccggcggacgcggagctggcggcgctgctggaggtggaaccggaggaccgggtcctgcggatcgagcggctgcggctggccggtggcgagccgatggccatcgaggcgacccacctctccgcccgccgcttccccggcctgcggcgcaacctcacccgctacacctctctctacaccacgctcgccgaggtgtacggggtccggcccgcggaggccgacgagaccatcgagacctccccggcgacaccgcgtgaggcgggcctcctcggcacggacgtgggcctgccgatgctgctgctgtcccgccactcgcgggacgagaacggggccccggtggagtgggtacggtcggtgtaccgcggctcccgctacaagttcaccgcgcgactgcggcgaccgcgggggtaa

SEQ ID NO: 468 - protein, 254 aa, Streptomyces sp 139
MSTDVSSAGADTRAPGRRDRVPKYYLIKQRLLQMTDERAPGSPMPAERLLAVEFGTSRTTVRKALLELVSEGRLDRIQGKGTFVARPKVYRTLQLTSYTEDMRAQGLSPASQVLDIGYVPADAELAALLEVEPEDRVLRIERLRLAGGEPMAIEATHLSARRFPGLRRNLTRYTSLYTTLAEVYGVRPAEADETIETSPATPREAGLLGTDVGLPMLLLSRHSRDENGAPVEWVRSVYRGSRYKFTARLRRPRG

SEQ ID NO: 469 - DNA, 726 bp, Streptococcus pyogenes
  CDS (1)..(726)
atgaataaccgacttgaggagtgtggcatgttaccagcttatataaaaattcatgatgcaattaaaaaagacattgatctgggcatctggccaattggtagtcgcttaccaagtgaacgacatttagcggaacatttcaccgttagtcgaatgactctacggcaggctattacattactagtagaagaagggattcttgaaaggcggataggaagtggtacttatgttgccagtcatcgtgttcaagaaaaaatgcgaggaacaacaagtttcacagaaattatacgctcccaaggacgacaaccctcctctaaattattatcctatcaaaagcaattagctagtgataccgaagttaaagaattgaacttagacaaaacagacttggtcattcgaatggaacgtatccgctatgcagacagtgtccctttggtgtacgaaattgcttcaatcccagaaaaatttataaaaacggttaaacgagctgatattacagaacacttttttcactcattgatagcaaatggttacgagattggtaaaagtaaacagacaatctacgctaagctagcaagtgagcgtgtagcctcctacttggaagttgctaaaggacatgccattttggctctaactcaggtgtcttactttacagacggcaaaccttttgagtatgtccgcagtcagtatatcggtgaccgttttgaattttacttagaaaataattag

SEQ ID NO: 470 - protein, 241 aa, Streptococcus pyogenes
MNNRLEECGMLPAYIKIHDAIKKDIDLGIWPIGSRLPSERHLAEHFTVSRMTLRQAITLLVEEGILERRIGSGTYVASHRVQEKMRGTTSFTEIIRSQGRQPSSKLLSYQKQLASDTEVKELNLDKTDLVIRMERIRYADSVPLVYEIASIPEKFIKTVKRADITEHFFHSLIANGYEIGKSKQTIYAKLASERVASYLEVAKGHAILALTQVSYFTDGKPFEYVRSQYIGDRFEFYLENN

SEQ ID NO: 471 - DNA, 726 bp, Clostridium perfringens
  CDS (1)..(726)
atgtttaagagaagcaggggcatagccctgtatcatcaattagaaacagagctaattgatcttataaatagcggagaacttaaggaaaatgataagttaccatctgaaagagaattatgtgagcaatataatgttagtagaacaacagctaggcaagctattggagaattagaaagaaaagagtatgtatataaggtccatggaaagggaacttttatatctcctaaagtgtataaacaacaattattaaaattttatagttttactgaagaaatgaaaaagcttgggaaaaatccatcttcaaaaatattatcctttgatttaataagagctgacaataagatttctgaaaaattaaaagtggaagaaaactcactggtatataagatagtaagactaagaatagcagatgaagttccaatgatggtagagtgtacttatttacctgaatatagatttattgatttgaaagaaaagatgcttaaagaaaagcctatgtatgatatatttagagaagtctataatgttagtctaactaaggctaaggaaagttttaaaccaatattaatttcaaagagtgattcaaaattattaaatgtggaagatggtacagctgcaatgagaattgaaagagttacctttgaaaatgaaagagttatagagtatacagtaagtgtttcaagaggagataaatttgaatatactgtagttttagaagaagattaa

SEQ ID NO: 472 - protein, 241 aa, Clostridium perfringens
MFKRSRGIALYHQLETELIDLINSGELKENDKLPSERELCEQYNVSRTTARQAIGELERKEYVYKVHGKGTFISPKVYKQQLLKFYSFTEEMKKLGKNPSSKILSFDLIRADNKISEKLKVEENSLVYKIVRLRIADEVPMMVECTYLPEYRFIDLKEKMLKEKPMYDIFREVYNVSLTKAKESFKPILISKSDSKLLNVEDGTAAMRIERVTFENERVIEYTVSVSRGDKFEYTVVLEED

SEQ ID NO: 473 - DNA, 765 bp, Streptomyces coelicolor
  CDS (1)..(765)
atgagcaccgacgtcagcagtgcggagaacgagggtggggcgaccgtccgtaccgcgcgcgtgcccaagtactaccgtctgaagaagcatctgctcgacatgacccggacccagacgccgggcacaccggtcccgccggagcgcaccctggccgccgagttcgacacctcgcgcacgacggtgcgccaggccctgcaggagctggtggtcgagggccgcctggagcgcatccagggcaagggcaccttcgtcgccaagcccaaggtgtcgcaggcgctgcaactcacctcgtacaccgaggacatgcgggcccagggcctcgaaccgacctctcagctgctggacatcggctacatcaccgccgacgaccggctcgccgggctgctggacatcacggccggcggccgggtgctgcgcatcgagcggctgcgcatggccaacggcgagccgatggccatcgagaccacccacctcagcgcgaagcgcttccccgccctgcgccgctccctggtgaagtacacgtccctctacaccgcgctcgccgaggtgtacgacgtccatctcgccgaggccgaggagaccatcgagacctccctggccaccccgcgcgaggccggtctgctcggcaccgacgtcggcctgcccatgctgatgctctcccggcactcccaggaccgcaccggccagccggtggagtgggtccgctcggtgtaccggggcgaccgctacaagttcgtggcccgcctcaagcggccccaggactaa

SEQ ID NO: 474 - protein, 254 aa, Streptomyces coelicolor
MSTDVSSAENEGGATVRTARVPKYYRLKKHLLDMTRTQTPGTPVPPERTLAAEFDTSRTTVRQALQELVVEGRLERIQGKGTFVAKPKVSQALQLTSYTEDMRAQGLEPTSQLLDIGYITADDRLAGLLDITAGGRVLRIERLRMANGEPMAIETTHLSAKRFPALRRSLVKYTSLYTALAEVYDVHLAEAEETIETSLATPREAGLLGTDVGLPMLMLSRHSQDRTGQPVEWVRSVYRGDRYKFVARLKRPQD

SEQ ID NO: 475 - DNA, 714 bp, Streptococcus mutans
  CDS (1)..(714)
atgaaaaaatatgaaattatttttaaaaaactagaagaagatattctcaaaggacactatcaaatgggtgactatcttccccctgaaatggaacttagccagacctatgccagcagccgagatactgttagaaaggctttacagctcttgactaaggcaggttttattaaaacagtacagggaaggggatcccaaattatcaagcgtgagcgcattaactttcctgtttctcaactaaccagctatcaagaattggttaaacaattgcagatgaatgtcaagacaaatgttattgctattgataaactgattgttgatgagaaactcaccaaactaaccggttttgaaaataaaggtcttgtctggcgcatcacaagacagcgcgtcatagacggcgttgcttccattttagatacggattatttggataaagcattgattcctcatatgaccagagaaatcgctgaacattctatctatgattatcttgaaaatcaacttaagctggacattgcctatgctcaaaagattattaccatagatcaagtatcgcaaaaagataaaattttgcttgatttggattctgaaaatcatgtcgtttcggttaaatctaaagtttatctcagtaatcagcagcaatttcaattcactgaaagccggcacaaactggaaaagttccgttttgttgactttgccagacggcatcgtgattaa

SEQ ID NO: 476 - protein, 237 aa, Streptococcus mutans
MKKYEIIFKKLEEDILKGHYQMGDYLPPEMELSQTYASSRDTVRKALQLLTKAGFIKTVQGRGSQIIKRERINFPVSQLTSYQELVKQLQMNVKTNVIAIDKLIVDEKLTKLTGFENKGLVWRITRQRVIDGVASILDTDYLDKALIPHMTREIAEHSIYDYLENQLKLDIAYAQKIITIDQVSQKDKILLDLDSENHVVSVKSKVYLSNQQQFQFTESRHKLEKFRFVDFARRHRD

SEQ ID NO: 477 - DNA, 699 bp, Escherichia coli O6
  CDS (1)..(699)
atgatttttcaaaagattgcccgcttacttaaatccgagatcaatggcaattcatggcatgttggtgatttgttgccgtcagaagcggaactcgctgttcgttataatgtttcgcgtaataccctgcgtaaggcattatccctgctggaaggcgaaggaattattcacagaaagcatggttcaggaacatacattcaaaaaaagaattttgttgcacacattgatcacatgaacagtttcagtgaaattgcacataaaagcggcaaagaggcaggaagtcagattatgaaatttgaagtgcaggatgcttctcctactattgcgactgagctgaatttagtgactggtgagcaggtttattacataaagagactgcgattcattgaggataatgcagcacaattagaagaaacgtggatgtcagtggcacgttttcctgatttaaccgtatcgcatatgcaaaaatccaaattttcgtatattgagaacgaatgcgggatcaaaatcattggcacctttgaaactttctccccgacttttcctacccctgaaatcgccagtattttacggatcagcccacgggatcccatacttaaaattcagacccaggctgtggatagtaactctattccgctggattattcgttactttacagcaatattttcgagttccaggtaaagtactttttcccgcgataa

SEQ ID NO: 478 - protein, 232 aa, Escherichia coli O6
MIFQKIARLLKSEINGNSWHVGDLLPSEAELAVRYNVSRNTLRKALSLLEGEGIIHRKHGSGTYIQKKNFVAHIDHMNSFSEIAHKSGKEAGSQIMKFEVQDASPTIATELNLVTGEQVYYIKRLRFIEDNAAQLEETWMSVARFPDLTVSHMQKSKFSYIENECGIKIIGTFETFSPTFPTPEIASILRISPRDPILKIQTQAVDSNSIPLDYSLLYSNIFEFQVKYFFPR

SEQ ID NO: 479 - DNA, 756 bp, Escherichia coli O6
  CDS (1)..(756)
atgcgcgccatgaaatcattaagtaagtcgtcacaaataccgctctatcaacaagtggtggagtggataagagaaagtatttataccggggatctggtggaagacgatcgcattccttcggaataccagattatggatatgctggaagtgagccggggaaccgttaaaaaagcggtcgcccaactggtaaaagaaggcgtgttgatacaggtccaggggaagggaacatttgtcaaaaaagagaacgtggcatatccgttaggtgaaggattattgtcattcgcggaatcgctggaaagccagaaaatacactttaccactgaagttattacgtcacggattgaaccggctaatcgttatgtggcagagaaattaagaataacgcccggtcaggatattctttaccttgagcgtttacgttcaattggtgatgaaaaagcgatgctgatagagaaccgtatcaatattgagctatgccccggcatcgtggaaatcgattttaatcaacacaatttatttccaacaatagaaagtttgtcgaaaagaaaaattcgttactcggaaagtcgctatgccgcgcgattaattggtaatgaacgcggtcattttttagatatcagtgaagatgcacccgttttgcatctggagcaattagtctttttctcccgagagttacccgttgagtttggcaacgtctggttaaaaggaaataaatattatctgggcaccgtgctgcaacggcgggaattgagttaa

SEQ ID NO: 480 - protein, 251 aa, Escherichia coli O6
MRAMKSLSKSSQIPLYQQVVEWIRESIYTGDLVEDDRIPSEYQIMDMLEVSRGTVKKAVAQLVKEGVLIQVQGKGTFVKKENVAYPLGEGLLSFAESLESQKIHFTTEVITSRIEPANRYVAEKLRITPGQDILYLERLRSIGDEKAMLIENRINIELCPGIVEIDFNQHNLFPTIESLSKRKIRYSESRYAARLIGNERGHFLDISEDAPVLHLEQLVFFSRELPVEFGNVWLKGNKYYLGTVLQRRELS

SEQ ID NO: 481 - DNA, 747 bp, Oceanobacillus iheyensis
  CDS (1)..(747)
atgattgataaaaattcacctataccaatttattaccaattagaagaatatataaaacatcaaattgataatcaaaagtggctgccgggagagcttcttccatctgaaagagaatttgcagaacaatatcatatcagccgtatgacagtccgccaggctataaataatttagctgctgctggccttctgtatcgtgtgaaagggaaaggaacctttattgctcaacctaaatttgaacatgacctttctggtttaacgagttttacagaagatatgatgcaacgaggcttaacgccgtctaatcaattgttatatattcaactgcataatcaaccgagtcaaattgcgcataagcttcaattacaatcagaggattcttactatgaaattaaacgaatacgctttgcagatgaagacccccttgcatttgaaattatttacaccccgaaaaaactaattggtgaactggaagaaaaatatttacaaggttctttttatcaatatgttgaacaaaaaataggaaagcacattattgttggaaatcaaacaattgaaggtgctcttgcaactaaagaacaagctaatttcttacaaattaatgtcggtgatccggtattaattatggaaagagtaagttatctagatcaaccgatagaagttcctattgaatttactcaaacgatatatcgtgcagataaatataaatttcacctcacgcttcatagagatgaacaaaccaagggctaa

SEQ ID NO: 482 - protein, 248 aa, Oceanobacillus iheyensis
MIDKNSPIPIYYQLEEYIKHQIDNQKWLPGELLPSEREFAEQYHISRMTVRQAINNLAAAGLLYRVKGKGTFIAQPKFEHDLSGLTSFTEDMMQRGLTPSNQLLYIQLHNQPSQIAHKLQLQSEDSYYEIKRIRFADEDPLAFEIIYTPKKLIGELEEKYLQGSFYQYVEQKIGKHIIVGNQTIEGALATKEQANFLQINVGDPVLIMERVSYLDQPIEVPIEFTQTIYRADKYKFHLTLHRDEQTKG

SEQ ID NO: 483 - DNA, 699 bp, Streptococcus agalactiae serotype III
  CDS (1)..(699)
atgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataactaa

SEQ ID NO: 484 - protein, 232 aa, Streptococcus agalactiae serotype III
MLPAYIKIHDAIKKEIDKGTWKIGQRLPSERDLADDYSVSRMTLRQSITLLVEEGILERRVGSGTYVASHRVQEKMRGTTSFTEIVNSQGRKPSSKLISFQRKLANETEIQKLNLSQSDYVVRMERVRYADKVPLVYEVASIPENLIKGFEQSEVTEHFFKTLTENGYEIGKSQQTIYARNASERVASHLEVNAGHAILALTQVSYFTDGKPFEYVHGQYVGDRFEFYLENN

SEQ ID NO: 485 - DNA, 699 bp, Streptococcus mutans
  CDS (1)..(699)
atgttaccggcttatattcgcattcatgatcaaatcaaaaaagaaatcgatgaaggtctttggaaaatcggcgatcgtcttcctagcgaacgtgatttggcagaacgatttgaagttagccgaatgacgcttcgacaggctataacactccttgttgaagaagggattttagagcgtcgagtgggaagcggtacttacatcgctagcagtcgtgttcaagaaaaaatgcgtgggacaactagttttacagaaattgtaaaatcacaaggcaaaacaccttcgaccaaattaatttcttaccggcgggttcatccaagcgaacaagaaataaaatttttagatattaaacctaaatcttatattatccgaatggagcgagttcgctatgcagatgatattcctgttgtttttgaagtgacagctattcctgaaaagattattaagagtttcaaaaaggaagctattaccaagcatttctttaaaacgttgacagatcatggttttgttatcggaaaaagtcagcaaaccatttctgccagtaatgctaatgagatgacggctgattatttggcgatctcgcgtggacatgcagtactaaccttggctcaagtttcctattttgaaaatggtatgccttttgaatatgtccgcagccaatatgtcggtgagcgttttgagttttatttagaaaataagtaa

SEQ ID NO: 486 - protein, 232 aa, Streptococcus mutans
MLPAYIRIHDQIKKEIDEGLWKIGDRLPSERDLAERFEVSRMTLRQAITLLVEEGILERRVGSGTYIASSRVQEKMRGTTSFTEIVKSQGKTPSTKLISYRRVHPSEQEIKFLDIKPKSYIIRMERVRYADDIPVVFEVTAIPEKIIKSFKKEAITKHFFKTLTDHGFVIGKSQQTISASNANEMTADYLAISRGHAVLTLAQVSYFENGMPFEYVRSQYVGERFEFYLENK

SEQ ID NO: 487 - DNA, 711 bp, Lactobacillus plantarum
  CDS (1)..(711)
atgagtaccatgagttcgccaatttatattcaaatccacaaccaaattaagcaggcgattgaagcaggtcggtgggccgttggtgaccggattccgtctgaacgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttagaagagaaggcaagtttagtgcctggtaaggctcaacagacggtttcggcgatgtctgcttctgagcgtatcgcggaatacttgtcagtccggcgtggcgatgcgttgctacggttacggcagatttcgtatttgcaaaccggcgaaccgtttgaatacgtgcggacccagtacgttggtaaccggtttgagttttatcttgaaaaataa

SEQ ID NO: 488 - protein, 236 aa, Lactobacillus plantarum
MSTMSSPIYIQIHNQIKQAIEAGRWAVGDRIPSERELATQFDVSRMTLRQAIQTLVDEGILERRVGAGTFVANQKVQEKMSGVTSFTDLMLAQGKVPSSKTISYHVTSPSLSESEKLALGANEQVLRMERIRYGDDVPICFEVATVPERLVKQFTKDEITSSLYRTLEEKASLVPGKAQQTVSAMSASERIAEYLSVRRGDALLRLRQISYLQTGEPFEYVRTQYVGNRFEFYLEK

SEQ ID NO: 489 - DNA, 927 bp, Pseudomonas putida strain KT2440
  CDS (1)..(927)
atggcggcgagcattgccacgtccttgttgtgcgggtttgccgagcacaagcataagccacatgcggtcctcccgacacaaggctgtttcgcctaccaaagggcgacaggcggaggattgacagcctgtcaggctcagggaatactctcgaaaaattcatatatatgtttatataacaagacgagagcgagacccatgcacccattgaccggtgatgctcgactgccccgctaccaacaactgcgcgatcacatggttgcgcaaattgccaacaaccgctggcgcccgggggaagcgatcccgaccgaggcagccttggccaccgagttcgacctgtcgatcggtaccgtgcgcaaggccgtcgatgtcctggtggccgaaggcgtgctggagcgccagcagggccgcggcaccttcattcgccgcccacagttccagtcgtcgctgttccgcttcttccgtttcgaggccgccaatggcgagcgcatagtgccggaaagccgcattctctccatcgagtcgctgccggcgccttccgcggtggccgaggcattgggcctggcaggggaggcagaagtgatccgcatcattcgcacacgtctgctcggcgcccagccggtgctggccgaagaaatctggctgccgcgccaaaccttccagccgctgctggacgtggatctgaacagcgagggcccgctgctgtacccgatctacgaagcgctgtgcggtcaggtggtcgcctacgccgaagaaaccctgaccgccgaagcggtcgacgcggtgcatggccgcttgctgcaactgccggccgacagcccggtggtcgtgatcgagcgcctggcccgcgattacgccggcaaacctctggaatggcgccgctcgcgcggccatgcgcagcacttccgctaccgcatcgacattcgttaa

SEQ ID NO: 490 - protein, 308 aa, Pseudomonas putida strain KT2440
MAASIATSLLCGFAEHKHKPHAVLPTQGCFAYQRATGGGLTACQAQGILSKNSYICLYNKTRARPMHPLTGDARLPRYQQLRDHMVAQIANNRWRPGEAIPTEAALATEFDLSIGTVRKAVDVLVAEGVLERQQGRGTFIRRPQFQSSLFRFFRFEAANGERIVPESRILSIESLPAPSAVAEALGLAGEAEVIRIIRTRLLGAQPVLAEEIWLPRQTFQPLLDVDLNSEGPLLYPIYEALCGQVVAYAEETLTAEAVDAVHGRLLQLPADSPVVVIERLARDYAGKPLEWRRSRGHAQHFRYRIDIR

SEQ ID NO: 491 - DNA, 723 bp, Shigella flexneri
  CDS (1)..(723)
atgggacacaaacccttataccgacagattgctgatcgcattcgtgagcaaattgcgcgtggcgagcttaaacctggcgatgcgttacctaccgaatcggcattacaaacagagtttggcgtcagccgggttacggtgcgtcaggctttgcgccagttagtcgagcaacagatcctcgaaagcattcagggcagcgggacttacgtcaaagaagagcgggtcaattacgatatttttcagttaaccagttttgatgaaaaactgtcggaccgtcacgtcgatacacacagtgaagttctgatatttgaagtgattccggctgacgattttcttcagcaacagctacaaatcaccgtgcaggatcgtgtgtggcatgtgaagcgcgtgcgctatcgcaagcaaaagccaatggcgctggaagaaacctggatgccgcttgcgttgttcccggatctcacctggcaggtcatggaaaattcgaaatatcactttattgaagaagtgaagaagatggttatcgatcgtagcgaacaggaaatcattcctctgatgccaaccgaagagatgagccgtctgcttaatatcagccagacaaagccgattcttgaaaaagtatcgcgtggatatttagttgatggtcgggtgtttgaatatagccgcaacgcttttaataccgatgactataaatttaccctgatagcgcagcgaaaatcatcgcgataa

SEQ ID NO: 492 - protein, 240 aa, Shigella flexneri
MGHKPLYRQIADRIREQIARGELKPGDALPTESALQTEFGVSRVTVRQALRQLVEQQILESIQGSGTYVKEERVNYDIFQLTSFDEKLSDRHVDTHSEVLIFEVIPADDFLQQQLQITVQDRVWHVKRVRYRKQKPMALEETWMPLALFPDLTWQVMENSKYHFIEEVKKMVIDRSEQEIIPLMPTEEMSRLLNISQTKPILEKVSRGYLVDGRVFEYSRNAFNTDDYKFTLIAQRKSSR

SEQ ID NO: 493 - DNA, 708 bp, Enterococcus faecalis Streptococcus faecalis
  CDS (1)..(708)
atggttcaaaatataccaatttatattcaaattcacgataaaatcaaagaagatattgaaaaaggtgtctggagtatcggggatcgtttgccctctgagcgagaattagccttgaaatttgatgttagtcgaatgaccttacgccaagccatccagactttagcagacgaagggattttagaacgaaaaattggttcaggaacgtatgtagcacgtaagaaagttcaagaaacaatgacaggtaccactagttttacagaaattaccttgtctcaaaatcgcgttccttctagtcggacggtgtcttattttgtagcgaaacctagttctagtgagatggaaaaattacaactaggtccagaagattcaattttacgaatggaaagaattcgttttgcggatgacattccgatttgttttgaggtggcgagcattccttattcattggtctcgcaatatggcaaatctgaaatcacgaactctttttataaaacacttgaagccaaatctggccacaaaattggccattctaaccaaacaatctctgctgttcaagcatcggaacagatcgcagaatatttagagattaaacgaggcgatgcgattctgcgtgtgcgccaagtatcctattttgaaaacggactaccttttgaatatgttcgtacgcagtatgcaggaagtcgatttgagttttatttagagaagtaa

SEQ ID NO: 494 - protein, 235 aa, Enterococcus faecalis Streptococcus faecalis
MVQNIPIYIQIHDKIKEDIEKGVWSIGDRLPSERELALKFDVSRMTLRQAIQTLADEGILERKIGSGTYVARKKVQETMTGTTSFTEITLSQNRVPSSRTVSYFVAKPSSSEMEKLQLGPEDSILRMERIRFADDIPICFEVASIPYSLVSQYGKSEITNSFYKTLEAKSGHKIGHSNQTISAVQASEQIAEYLEIKRGDAILRVRQVSYFENGLPFEYVRTQYAGSRFEFYLEK

SEQ ID NO: 495 - DNA, 732 bp, Enterococcus faecalis Streptococcus faecalis
  CDS (1)..(732)
atggaaaatgcctttaaaaacaaagctttgtatcatcaacttgttgatttgctgcaggaacgaatcgaaacatgcatgattcctcatgacaagttgccctctgaacgtgaattgactgcacaatatggagtgagtcggacgacggtccggttagcgctacaagaactagaaaatagaggttccatctatcgtcgtcatggcaaaggaacatttgtttcagatataaaaaaagaggccgctgatttagctggcgcatatagttttacagaacaaatgaaagggctgggtcgaaaaccacatacccgtatattatccttcgaaaaattggaagcggataaatttatttgtcagcatttgaatctttcgttaggagaggcagtttttaaattaagtcggttgcggattgctgataacgagccattaatggttgaagacacatacttgcctgtgaaatttttcttatcactcacggatcaattactacgtagcaaaccattatatgatctattttcggaagattttaagcaaaccgttcgtttagctgatgaagaattatacgctagcattgcgtcaaaagaagatgccaaattattgatgattccggaaggagcgccagtccttcatttagcacgccagacatataacatgaaaaatgaaattattgaatttacgttgagtgtggcgcgagcagatcaatttcattatcagatacgccatattcggaatagttaa

SEQ ID NO: 496 - protein, 243 aa, Enterococcus faecalis Streptococcus faecalis
MENAFKNKALYHQLVDLLQERIETCMIPHDKLPSERELTAQYGVSRTTVRLALQELENRGSIYRRHGKGTFVSDIKKEAADLAGAYSFTEQMKGLGRKPHTRILSFEKLEADKFICQHLNLSLGEAVFKLSRLRIADNEPLMVEDTYLPVKFFLSLTDQLLRSKPLYDLFSEDFKQTVRLADEELYASIASKEDAKLLMIPEGAPVLHLARQTYNMKNEIIEFTLSVARADQFHYQIRHIRNS

SEQ ID NO: 497 - DNA, 765 bp, Streptomyces avermitilis
  CDS (1)..(765)
atgagcaccgacgtcagcagtgcggagaacgagggcggggcacccatccgtaccgcgcgtgtgcccaagtactaccgcctgaagaagcacctgctcgacatgacggagacgctgccgcccggcacacccgtgccgcccgagcgcacgctggccgccgagttcgacacctcccgcacgaccgtccgccaggccctccaggagctggtcgtcgagggccgcctggagcgcatccagggcaagggcacgttcgtcgccaagccgaaggtctcccaggcgctgcaactcacctcgtacaccgaggacatgcgcgcccagggtctcgaaccgacctcgcagctcctggacatcggctacatcaccgcggacgacaccctcgccgggctgctcgacatcaccgcgggcggccgcgtgctgcgcatcgagcggctgcgcctggccagcggcgagccgatggccatcgagacgacccatctgtccgccaagcgcttccccgcgctgcgcaggtcgctggtcaagtacacgtcgctctacaccgcgctcgccgaggtctacgacgtccgtctcgccgaggccgaggagaccatcgagacctcgctggccaccccgcgcgaggccggactgctgggcaccgacgtcggcctgcccatgctgatgctctcgcggcactcgctggacaaggacggccggccggtggagtgggtgcggtcggtgtaccgcggggaccgctacaagttcgtggcgagactcaagcgcccccaggactaa

SEQ ID NO: 498 - protein, 254 aa, Streptomyces avermitilis
MSTDVSSAENEGGAPIRTARVPKYYRLKKHLLDMTETLPPGTPVPPERTLAAEFDTSRTTVRQALQELVVEGRLERIQGKGTFVAKPKVSQALQLTSYTEDMRAQGLEPTSQLLDIGYITADDTLAGLLDITAGGRVLRIERLRLASGEPMAIETTHLSAKRFPALRRSLVKYTSLYTALAEVYDVRLAEAEETIETSLATPREAGLLGTDVGLPMLMLSRHSLDKDGRPVEWVRSVYRGDRYKFVARLKRPQD

SEQ ID NO: 499 - DNA, 738 bp, Bacillus anthracis strain Ames
  CDS (1)..(738)
atggcaagcggatccacacaagtaaaatacctcggcatttatcaaaaaatgaaacagcaaattttagacggcgaatataagattaacgaaaaaattccaagtagccccgtccttgctgaagaatttgatgtttctgtccttactataaaaaaagcgctggatctgttagttagagacggctacatcattcgccggcgcggaagtggaacagtcgttcaagattggcgtcagcaggaaaaagcacgaatgattcaaactttaacaggtacaaaagctgtttatggcagcgaggtagaaagtaaaattattgagtttacgattgtcggtgccgatgaaattattgctgaaaaattgggcatttcagtaggagattttgtatataaaatcatccgcctccgcatcattcacagtattccaacgattatggagcatacatggatgccgatttcggtcattccaggtgttgaagtttctgttttagaggaatcaatctactcccacattcaaaataaactaggccttcaagtgggaacatccgttgttagggtaaaaggaattcgcccggatgataaagaaaagcagtttatgaacttaacaaatcaagatttcctaatgagagtggaacaggtggcctacttaacggatggacgcacttttgaatactcttacgccgatcacttgccggaaacctttgaattcgaaacagttattactgcaaaaagttataaagaggcataa

SEQ ID NO: 500 - protein, 245 aa, Bacillus anthracis strain Ames
MASGSTQVKYLGIYQKMKQQILDGEYKINEKIPSSPVLAEEFDVSVLTIKKALDLLVRDGYIIRRRGSGTVVQDWRQQEKARMIQTLTGTKAVYGSEVESKIIEFTIVGADEIIAEKLGISVGDFVYKIIRLRIIHSIPTIMEHTWMPISVIPGVEVSVLEESIYSHIQNKLGLQVGTSVVRVKGIRPDDKEKQFMNLTNQDFLMRVEQVAYLTDGRTFEYSYADHLPETFEFETVITAKSYKEA

SEQ ID NO: 501 - DNA, 732 bp, Bacillus anthracis strain Ames
  CDS (1)..(732)
atgaacatcgacaagtattcaccatttccgatctattatcagattcaagagtgggtgaaacagctaattgaggacggcgaatggaagccgggagataaaatcccatctgagaatgaactttgcgataagttcgaagtgagtcgtatgacaatcagacaggcgattaataatttagtggaacaaggttatttatatcggaaacgtggaatcggtacgtttgtccaacttccgaaagtggaacaaaaattgcaaggaatgacaggattcacagaagatatgatttctcgtggaatgaacccaagtagtcaattgctaagtttccgcctagttccagctactgcgaaaatagcagaccggctgagaatacaggagggagaatcggtttatgaagtgagacgtattcgtttagcggatgatgaaccgattgcttttgagacgacatatttgtcgccagctcttgtaaaagatattaacgaagaaatattgcaacaatctttatatgaacatctagagaaaaaactgggctttaaacttgttagcgctactcaatcaattgaagcttcaattgcaacggataatgaagcggaacatctgcatattcctaaaaaggcgccagtgcttgtaatgcgtcaatggtcatattcagaaggtgaagtaccgttagagtatgtgaaatgtatttatcgcggggatcgttataagtttattacgaacatcgcacgtaacaaataa

SEQ ID NO: 502 - protein, 243 aa, Bacillus anthracis strain Ames
MNIDKYSPFPIYYQIQEWVKQLIEDGEWKPGDKIPSENELCDKFEVSRMTIRQAINNLVEQGYLYRKRGIGTFVQLPKVEQKLQGMTGFTEDMISRGMNPSSQLLSFRLVPATAKIADRLRIQEGESVYEVRRIRLADDEPIAFETTYLSPALVKDINEEILQQSLYEHLEKKLGFKLVSATQSIEASIATDNEAEHLHIPKKAPVLVMRQWSYSEGEVPLEYVKCIYRGDRYKFITNIARNK

SEQ ID NO: 503 - DNA, 738 bp, Bacillus cereus strain ATCC 14579 DSM 31
  CDS (1)..(738)
atgctgatgaacatcgacaagtattcaccatttccgatctattatcagattcaagagtgggtgaaacagctaattgaggacggcgaatggaagccgggagataaaatcccatctgagaatgaactttgtgataagttcgaagtgagtcgaatgacaatcagacaggcgattaataatttagtggaacaaggctatttatatcggaagcgtggaattggaacatttgtccaacttccgaaagtggaacaaaaattgcaaggaatgacgggattcacagaagacatgatttctcgtgggatgaacccaagtagtcaattacttagtttccgcctagttccagctactgctaaaatagcagaccggttgagaatacaggagggggaatcggtttatgaagtgaggcgtattcgcttagctgatgatgaaccgattgcttttgagacgacatatttgtcgccagctcttgtaaaagatattaacgaagagatattgcaacaatctttatatgaacatttagagaaaaaactgggctttaaacttgttagcgctactcagtcaattgaagcttccgttgcgacggaaaatgaagctgaacatctgcatattcctaaaaaggcgcctgtacttgtaatgcgtcaatggtcatattcagaaggtgagataccgctagagtacgtgaaatgtatttatcgtggagatcgttataaatttattacgaatatcgcacgtaacaaatag

SEQ ID NO: 504 - protein, 245 aa, Bacillus cereus strain ATCC 14579 DSM 31
MLMNIDKYSPFPIYYQIQEWVKQLIEDGEWKPGDKIPSENELCDKFEVSRMTIRQAINNLVEQGYLYRKRGIGTFVQLPKVEQKLQGMTGFTEDMISRGMNPSSQLLSFRLVPATAKIADRLRIQEGESVYEVRRIRLADDEPIAFETTYLSPALVKDINEEILQQSLYEHLEKKLGFKLVSATQSIEASVATENEAEHLHIPKKAPVLVMRQWSYSEGEIPLEYVKCIYRGDRYKFITNIARNK

SEQ ID NO: 505 - DNA, 675 bp, Shigella flexneri
  CDS (1)..(675)
atgatctacaaaagcattgcggagcggttaagaattcgacttaattccgcggatttcacgctaaacagccttcttcccggtgaaaaaaagctggcggaagagtttgcggtatcgcggatgactatccgtaaagccattgacctgctggtagcgtgggggctggtggtccgccgccacggcagcggcacttacctggtgcgcaaagatgtgctgcatcaaaccgccagcctgaccggactggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctaatgctggaagacagctatatgccggtaaaactgttccgtaacctttcgctgcaacatctggaagggtcgaagtttgaatatattgaacaagagtgcgggattttgattggcggtaattatgaaagcctgatgccggtgctcgccgatagactgctggcgcggcaaatgaaggtagcggaacacacgccactgctgcggatcacctcgttgtcatatagcgagagcggggagtttttgaattattcagtgatgttcagaaatgccagcgaatactaa

SEQ ID NO: 506 - protein, 224 aa, Shigella flexneri
MIYKSIAERLRIRLNSADFTLNSLLPGEKKLAEEFAVSRMTIRKAIDLLVAWGLVVRRHGSGTYLVRKDVLHQTASLTGLVEVLKRQGKTVTSQVLIFEIMPAPPAIASQLRIQINEQIYFSRRVRFVEGKPLMLEDSYMPVKLFRNLSLQHLEGSKFEYIEQECGILIGGNYESLMPVLADRLLARQMKVAEHTPLLRITSLSYSESGEFLNYSVMFRNASEY

SEQ ID NO: 507 - DNA, 747 bp, Bordetella bronchiseptica Alcaligenes bronchisepticus
  CDS (1)..(747)
atgatgtctaaatcaaaccatgcgccgctctatgcccgggtcgaggccgtgctggccgaggcgatcgccgcgggcgaactgccgccgggcagccagttgcccgccgaagacggcctgatcgcgcgcttccaggtcagccgcaccacggtgcgcaaggccatccagaacctggccgagcgcgggctggtcgagatccggcgcggcaagggcaccttcgtggcgcagccgagggtggtgcaggagctcaccgagctcaccggtttcgtggaggacatgcaggccttgggccgcgtgccctcggcgcgcctgctggacgccgagatcgtggccgccggccaggccgtggcgcgccagctggcggtggcgccgggcacgcaggtcatgcgcatccggcgcgtgcgcctggccgatggcgtggccatgtcgctggacgaaacctatctgccgcgcgaaatcggcgaacaggtcgtcacgcacgacctggaggccgagcccatcttcgcgctgctggaacagaaatacgacctgccgctggtcgaggccgaataccggctcgaggccgccatcgccacgcccgaagtggcgcgggccctggcggtgccgcccggcagcccggtcttcctgatcgagcgcacctcgtattgcgcgggcccccggcccatcgactacgaaaagctgtactaccgcggcgacctgatccgcttcgtgacgcggctggcgcggcgcgcgcggcccgtgccggcataa

SEQ ID NO: 508 - protein, 248 aa, Bordetella bronchiseptica Alcaligenes bronchisepticus
MMSKSNHAPLYARVEAVLAEAIAAGELPPGSQLPAEDGLIARFQVSRTTVRKAIQNLAERGLVEIRRGKGTFVAQPRVVQELTELTGFVEDMQALGRVPSARLLDAEIVAAGQAVARQLAVAPGTQVMRIRRVRLADGVAMSLDETYLPREIGEQVVTHDLEAEPIFALLEQKYDLPLVEAEYRLEAAIATPEVARALAVPPGSPVFLIERTSYCAGPRPIDYEKLYYRGDLIRFVTRLARRARPVPA

SEQ ID NO: 509 - DNA, 747 bp, Bordetella parapertussis
  CDS (1)..(747)
atgatgtctgaatcgaaccatgccccgctctatgcccgggtcgaggccgtgctggccgaggcgatcgccgcgggcgaactgccgccgggcagccagttgcccgccgaagacggcctgatcgcgcgcttccaggtcagccgcaccacggtgcgcaaggccatccagaacctggccgagcgtgggctggtcgagatccggcgcggcaagggcaccttcgtggcgcagccgagggtggtgcaggagctcaccgagctcaccggtttcgtggaggacatgcaggccttgggccgcgtgccctcggcgcgcctgctggacgccgagatcgtggccgccggccaggccgtggcgcgccagctggcggtggcgccgggcacgcaggtcatgcgcatccggcgcgtgcgcctggccgatggcgtggccatgtcgctggacgaaacctatctgccgcgcgaaatcggcgaacaggtcgtcacgcacgacctggaggccgagcccatcttcgcgctgctggaacagaaatacgacctgccgctggtcgaggccgaataccggctcgaggccgccatcgccacgcccgaagtggcgcgggccctggcggtgccgcccggcagtccggtcttcctgatcgagcgcacctcgtattgcgcgggccctcggcccatcgactacgaaaagctgtactaccgcggcgacctgatccgcttcgtgacgcggctggcgcggcgcgcgcggcccgtgccggcataa

SEQ ID NO: 510 - protein, 248 aa, Bordetella parapertussis
MMSESNHAPLYARVEAVLAEAIAAGELPPGSQLPAEDGLIARFQVSRTTVRKAIQNLAERGLVEIRRGKGTFVAQPRVVQELTELTGFVEDMQALGRVPSARLLDAEIVAAGQAVARQLAVAPGTQVMRIRRVRLADGVAMSLDETYLPREIGEQVVTHDLEAEPIFALLEQKYDLPLVEAEYRLEAAIATPEVARALAVPPGSPVFLIERTSYCAGPRPIDYEKLYYRGDLIRFVTRLARRARPVPA

SEQ ID NO: 511 - protein, 23 aa, Consensus
  misc_feature (2)..(2): Xaa can be Arg or Ile or Val
  misc_feature (3)..(3): Xaa can be any naturally occurring amino acid
  misc_feature (5)..(11): Xaa can be any naturally occurring amino acid
  misc_feature (13)..(22): Xaa can be any naturally occurring amino acid
SXXTXXXXXXXLXXXXXXXXXXG

SEQ ID NO: 512 - protein, 325 aa, Consensus
  misc_feature (1)..(77): Xaa can be any naturally occurring amino acid
  misc_feature (79)..(100): Xaa can be any naturally occurring amino acid
  misc_feature (102)..(102): Xaa can be any naturally occurring amino acid
  misc_feature (104)..(105): Xaa can be any naturally occurring amino acid
  misc_feature (107)..(112): Xaa can be any naturally occurring amino acid
  misc_feature (115)..(115): Xaa can be any naturally occurring amino acid
  misc_feature (117)..(119): Xaa can be any naturally occurring amino acid
  misc_feature (121)..(123): Xaa can be any naturally occurring amino acid
  misc_feature (125)..(127): Xaa can be any naturally occurring amino acid
  misc_feature (129)..(134): Xaa can be any naturally occurring amino acid
  misc_feature (136)..(136): Xaa can be any naturally occurring amino acid
  misc_feature (139)..(161): Xaa can be any naturally occurring amino acid
  misc_feature (163)..(190): Xaa can be any naturally occurring amino acid
  misc_feature (192)..(204): Xaa can be any naturally occurring amino acid
  misc_feature (206)..(206): Xaa can be any naturally occurring amino acid
  misc_feature (208)..(212): Xaa can be any naturally occurring amino acid
  misc_feature (214)..(216): Xaa can be any naturally occurring amino acid
  misc_feature (218)..(272): Xaa can be any naturally occurring amino acid
  misc_feature (274)..(298): Xaa can be any naturally occurring amino acid
  misc_feature (300)..(325): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXPXEXXLXXXXXXSRXTXXXAXXXLXXXGXXXXXXGXGTXXXXXXXXXXXXXXXXXXXXXXXEXXXXXXXXXXXXXXXXXXXXXXXXXXXXLXXXXXXXXXXXXXRXRXXXXXPXXXEXXXXXXXXXXXXXXXXXXXXXXXXXXXXXXXXXXXXXXXXXXXXXXXXXXXXXXXLXXXXXXXXXXXXXXXXXXXXXXXXXEXXXXXXXXXXXXXXXXXXXXXXXXXX

SEQ ID NO: 513 - DNA, 882 bp, Escherichia coli
  CDS (1)..(882)
atgatgcgaatcgcgctcttcctgctaacgaacctggccgtaatggtcgttttcgggctggtactgagcctgacagggatacagtcgagcagcgttcaggggctgatgatcatggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaacgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtattctggcgcagcttgccgcgggttttatgggcggaaatcgtgatgaaggtgaagagagcaacggcaacccgctgatctactttgcggttgcaacggttctggaactggtgtttggtattctggcgagcattatcaccatgtggttctcgcgtcatcgtgaattccatgctgatgccggttcggcaaaactggttggtcgcgagaaaatgattgccgcgctgcagcgcctgaaaaccagctatgaaccgcaagaagcaaccagcatgatggctctctgcattaacggtaagtcgaaatcgctcagtgagttgttcatgacccacccgccgctggataaacgaattgaagctctgcgtacgggtgaatacctgaagtaa

SEQ ID NO: 514 - protein, 293 aa, Escherichia coli
MMRIALFLLTNLAVMVVFGLVLSLTGIQSSSVQGLMIMALLFGFGGSFVSLLMSKWMALRSVGGEVIEQPRNERERWLVNTVATQARQAGIAMPQVAIYHAPDINAFATGARRDASLVAVSTGLLQNMSPDEAEAVIAHEISHIANGDMVTMTLIQGVVNTFVIFISRILAQLAAGFMGGNRDEGEESNGNPLIYFAVATVLELVFGILASIITMWFSRHREFHADAGSAKLVGREKMIAALQRLKTSYEPQEATSMMALCINGKSKSLSELFMTHPPLDKRIEALRTGEYLK

SEQ ID NO: 515 - DNA, 22 bp, Primer
atgatgcgaatcgcgctcttcc

SEQ ID NO: 516 - DNA, 24 bp, Primer
ttacttcaggtattcacccgtacg

SEQ ID NO: 517 - DNA, 882 bp, Escherichia coli; identical to SEQ ID NO: 513
  CDS (1)..(882)

SEQ ID NO: 518 - protein, 293 aa, Escherichia coli; identical to SEQ ID NO: 514

SEQ ID NO: 519 - DNA, 882 bp, Escherichia coli
  CDS (1)..(882)
atgatgcgaatcgcgctcttcctgctaacgaacctggccgtaatggtcgttttcgggctggtactgagcctgacagggatacagtcgagcagcgttcaggggctgatgatcatggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaacgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtatcctggcgcagcttgccgcgggttttatgggcggaaatcgtgatgaaggtgaagagagcaacggcaacccgctgatctactttgcggttgcaacggttctggaactggtgtttggtattctggcgagcattatcaccatgtggttctcgcgtcatcgtgaattccatgctgatgccggttcggcaaaactggttggtcgcgagaaaatgattgccgcgctgcagcgcctgaaaaccagctatgaaccgcaagaagcaaccagcatgatggctttctgcattaacggtaagtcgaaatcgctcagtgagttgtttatgactcacccgccgctggataaacgtattgaagctctgcgtacgggtgaatacctgaagtaa

SEQ ID NO: 520 - protein, 293 aa, Escherichia coli
MMRIALFLLTNLAVMVVFGLVLSLTGIQSSSVQGLMIMALLFGFGGSFVSLLMSKWMALRSVGGEVIEQPRNERERWLVNTVATQARQAGIAMPQVAIYHAPDINAFATGARRDASLVAVSTGLLQNMSPDEAEAVIAHEISHIANGDMVTMTLIQGVVNTFVIFISRILAQLAAGFMGGNRDEGEESNGNPLIYFAVATVLELVFGILASIITMWFSRHREFHADAGSAKLVGREKMIAALQRLKTSYEPQEATSMMAFCINGKSKSLSELFMTHPPLDKRIEALRTGEYLK

SEQ ID NO: 521 - DNA, 882 bp, Escherichia coli; identical to SEQ ID NO: 519
  CDS (1)..(882)

SEQ ID NO: 522 - protein, 293 aa, Escherichia coli; identical to SEQ ID NO: 520

SEQ ID NO: 523 - DNA, 882 bp, Salmonella enterica subsp. enterica serovar Typhi
  CDS (1)..(882)
atgatgcgaatcgcgctcttcctgctgacgaacctggccgtgatggtcgttttcgggctggttctgagcctgacagggatacagtcgagcagcgtgcaaggcttgctgatcatggcgctgctgtttggttttggcggttcttttatttcattgctgatgtccaaatggatggcgttaaaatccgtaggaggggaagttattgaacagcctcgcaatgaaagagaacgctggttgatgaacaccgtagcaacgcaagcgcgccaggctggtatcgccatgccgcaggttgctatctaccatgcgccggacattaacgcgtttgcgacgggcgcacgccgtgacgcctcattggtcgctgtgagcaccggtctgttgcaaaatatgagccctgacgaggcggaagccgtcattgcgcatgaaatcagccatattgccaatggcgatatggtgacgatgacgttgattcagggggtggttaacaccttcgttatctttatttcgcgcattatcgcgcaaattgctgctggttttctgggcggcaaccgtgatgaaggcgaaggaagtaacggtaatccgctaatctatttcgccgttgcgacggtgctggaactggtcttcggtattctggcaagcattatcaccatgtggttctcccgttaccgtgagtttcatgccgatgcgggatcggcgaagctggtgggccgtgaaaaaatgattgccgcgttgcagcgcctgaaaaccagctacgagccgcaagaagcgaccagcatgatggcgttttgtattaacggtaaatcgaaatcgttaagcgagctgtttatgacgcacccaccgctggataaacgcattgaagcgctgcgtagcggcgagtacctgaaataa

SEQ ID NO: 524 - protein, 293 aa, Salmonella enterica subsp. enterica serovar Typhi
MMRIALFLLTNLAVMVVFGLVLSLTGIQSSSVQGLLIMALLFGFGGSFISLLMSKWMALKSVGGEVIEQPRNERERWLMNTVATQARQAGIAMPQVAIYHAPDINAFATGARRDASLVAVSTGLLQNMSPDEAEAVIAHEISHIANGDMVTMTLIQGVVNTFVIFISRIIAQIAAGFLGGNRDEGEGSNGNPLIYFAVATVLELVFGILASIITMWFSRYREFHADAGSAKLVGREKMIAALQRLKTSYEPQEATSMMAFCINGKSKSLSELFMTHPPLDKRIEALRSGEYLK

SEQ ID NO: 525 - DNA, 882 bp, Yersinia pestis
  CDS (1)..(882)
atgatgcgtatcgctctgttccttctcaccaacctggcggtgatgctagtgttcgggttggtgttaagtctgacgggaattcagtcaagcagtgtgcaggggctgatgattatggcgggtctgtttggtttcggcggcgcatttgtttcgttactgatgtccaaatggatggctttacgttcagtaggcggggaggttattgaacggccacgtaatgaaacagaatattggttgttggaaaccgtacgtcgccagtctcaacaggtagggatcgccatgccacaagtggctatttatcaggcaccggatattaacgcctttgcgacgggggcacgtcgagatgcctctctggtggcggtcagtaccggtttattgcaaaatatgagccgtgatgaggctgaagccgtgattgcccatgaaatcagtcatgtggctaatggtgatatggtaaccatgactttgattcaaggggtcgtgaatacgttcgtgatctttatttcacgactgattgcacaaattgccgctggtttcttatcaggtgaccgagacggtgaaagtaacagccccggtaatccaatggtctattttgccgtatcaatggtactagaattagtgttcggcattcttgccagtattattaccatgtggttttcacgccatcgtgagttccatgcagatgccggttccgcaaaattggttgggcgtgaaaaaatgattgcggcattacaacggctgaaaaccagctatgaaccgcaggaagcgggtagcatgatggctttctgtattaatggtaaatctaaaacgtttagtgaattgtttatgtcacacccgcctttagataaacgtatagaggcattacgttctggtcagtatctgaagtaa

SEQ ID NO: 526 - protein, 293 aa, Yersinia pestis
MMRIALFLLTNLAVMLVFGLVLSLTGIQSSSVQGLMIMAGLFGFGGAFVSLLMSKWMALRSVGGEVIERPRNETEYWLLETVRRQSQQVGIAMPQVAIYQAPDINAFATGARRDASLVAVSTGLLQNMSRDEAEAVIAHEISHVANGDMVTMTLIQGVVNTFVIFISRLIAQIAAGFLSGDRDGESNSPGNPMVYFAVSMVLELVFGILASIITMWFSRHREFHADAGSAKLVGREKMIAALQRLKTSYEPQEAGSMMAFCINGKSKTFSELFMSHPPLDKRIEALRSGQYLK

SEQ ID NO: 527 - DNA, 879 bp, Buchnera sp.
  CDS (1)..(879)
atgactcgtattgttcttttcttattaactaatttagcagttatgttaatatttagtctaattcttttcctgacaggtattcaatctaatactatttatggtttattaattatgtcaggtttatttggttttagtggttctattttatcgttaattttatcaaagtggattgcgttgcgttctgtaaatggggaaatcatcactcatccacgaaatgaagtagaaagttggcttattaatactgtacgtcaacaatcaattcaaaaaggtattattatgccccaaattgcagtatatcatgcgactgatattaatgcatttgcaacaggtgcacgtcgtaattctgctctaattgctgtttctacaggattattagaaaatatgactcatcatgaagcagaagcagtaattgctcatgaaattagtcatatcgcaaatggtgacatgattactatgaccttagtacaaggtgttgttaacacttttgtgatttttatatctcgttttctttcacaaatcataagcaatgtcatgtcaagcaatcgaaatgagaataatacagaagaaaaaaactctttcgtatattttttagtttctacatttctagaattaatttttggaattttagccagtattattactatgtggttctccagacatcgtgaattttatgctgatgctagttctgcgaaaatggtaggtcgcgaaaaaatgattgctgctttgaatcgtttaaaaacaagtcatgaaccccaagaatctgatagtatgattgcattttgtatcaacggaaaatccaaatcttttttaaaattatttgcatctcatccttctttagaaaacaggatagaggcattatataatcaagaatatatgtaa

SEQ ID NO: 528 - protein, 292 aa, Buchnera sp.
MTRIVLFLLTNLAVMLIFSLILFLTGIQSNTIYGLLIMSGLFGFSGSILSLILSKWIALRSVNGEIITHPRNEVESWLINTVRQQSIQKGIIMPQIAVYHATDINAFATGARRNSALIAVSTGLLENMTHHEAEAVIAHEISHIANGDMITMTLVQGVVNTFVIFISRFLSQIISNVMSSNRNENNTEEKNSFVYFLVSTFLELIFGILASIITMWFSRHREFYADASSAKMVGREKMIAALNRLKTSHEPQESDSMIAFCINGKSKSFLKLFASHPSLENRIEALYNQEYM

SEQ ID NO: 529 - DNA, 777 bp, Vibrio vulnificus
  CDS (1)..(777)
atgcagccagggagcctctcaggtttattggtgatggctgcggtatttggttttggtggtgcatttatctccttgatgatgtcaaaggggatggcactacgctctgtcggtggaatggtgatcgagagccctcgtaacgagacagagcactggttattggaaacggtgagccgccaagctcaacaagcgggcattggtatgccaaccgttgccatttatgattcgccggacatcaacgcgtttgcaactggggcaaaacgtgacgattcgctggtcgcggtttctacgggtctgttgcacaacatgacgcgtgatgaagcagaagcggtgctggcgcatgaggtgagccatattgccaatggtgacatggtgaccatgacgttgatgcagggtgttgtgaacaccttcgttatcttcttgtctcgctttattgccaacatggtggcttctaataacagcgatgaagaaggtgaaggttcaaacatgatggtgtatttcgcggtttctatcgcgcttgagctggtgtttggtttcctcgcgagcttcatcaccatgtggtatagccgtcatcgtgaattccatgccgatgcgggagccgcccgtctagttggtaaagagaaaatgatagcggctctagagcgtctaaaaatgagccaagaatcaaaactggatggcaccatgatggcatttggtattaacggtaagcaatctctaacagaactgcttatgagccacccgccactcgataagcgtatcgctgcccttcgcaatttctaa

SEQ ID NO: 530 - protein, 258 aa, Vibrio vulnificus
MQPGSLSGLLVMAAVFGFGGAFISLMMSKGMALRSVGGMVIESPRNETEHWLLETVSRQAQQAGIGMPTVAIYDSPDINAFATGAKRDDSLVAVSTGLLHNMTRDEAEAVLAHEVSHIANGDMVTMTLMQGVVNTFVIFLSRFIANMVASNNSDEEGEGSNMMVYFAVSIALELVFGFLASFITMWYSRHREFHADAGAARLVGKEKMIAALERLKMSQESKLDGTMMAFGINGKQSLTELLMSHPPLDKRIAALRNF

SEQ ID NO: 531 - DNA, 864 bp, Vibrio cholerae
  CDS (1)..(864)
atgaaacgtatattgttattcttagcaaccaaccttgctgtcgtattggtgcttagtgttgttttgaatattgtttatgccgtcacgggcatgcagccagggagtttgtctggtctgttggtgatggcggctgtgtttggctttggcggtgcatttatttcactgctgatgtcaaaaagtatggccctacgctcagtgggtggtgtcgtcattgatactccacgcaatgagatggaacattggctattggaaacggtacgtcgccaagcaaaccaagcgggtatcggtatgccaacggtggcgatttatgatgcgccagacatgaatgcgtttgccacgggtgcaaagcgtgatgattctctggtcgcggtctcaacgggattgctgcacaacatgacgcgtgatgaggccgaagctgtgttggcgcatgaagttagccacattgctaacggtgacatggtcaccatgacgctgatgcaaggggtggtgaacaccttcgtgatcttcttgtcgcgctttattgccaatatcgtggcttcacgtgattcggaagaaggtgaaggtagcaacatgatggtctatttcggtgtatctatggtgcttgaattggtgtttggtttcttagccagcttcatcaccatgtggtatagccgccaccgtgagttccatgccgatgcgggtgccgctcagttagtcggtaagcacaagatgattgcggcgttagaacgcctgaaaatgggtcaggagtcgcatcttgaaggttcgatgatggcgtttggcatcacaggtaaacgctctctatccgaattaatgatgactcacccaccccttgaaaaacgtatcgcagcactgcgcaatatgtaa

SEQ ID NO: 532 - protein, 287 aa, Vibrio cholerae
MKRILLFLATNLAVVLVLSVVLNIVYAVTGMQPGSLSGLLVMAAVFGFGGAFISLLMSKSMALRSVGGVVIDTPRNEMEHWLLETVRRQANQAGIGMPTVAIYDAPDMNAFATGAKRDDSLVAVSTGLLHNMTRDEAEAVLAHEVSHIANGDMVTMTLMQGVVNTFVIFLSRFIANIVASRDSEEGEGSNMMVYFGVSMVLELVFGFLASFITMWYSRHREFHADAGAAQLVGKHKMIAALERLKMGQESHLEGSMMAFGITGKRSLSELMMTHPPLEKRIAALRNM

SEQ ID NO: 533 - DNA, 852 bp, Haemophilus influenzae
  CDS (1)..(852)
atgatgcgtattcttcttttcttggcaaccaatatggctgtaatgctggtattaggtattattttaagtgtgactggaattgcaggaaatagcaccggcggtattttaattatggctttgctatttggttttgctggctcattaatttccttattcctgtctaaaacgatggcattacgttctgtagatggagaggtgattactcaacctcgtaatcaaactgaacgttggttaattgataccgttagtcgccaagcgcagaaagcgggtattcctatgccagacgtggcgatttatcattcacccgatgtgaatgcttttgcgacaggtgcgacaaaaagcaattctttggtggctgtgagtacgggattattaaacaacatgacggaggctgaagctgaagctgttttagcgcacgaaatttctcatatttccaatggggatatggtgacgatggcgttattgcaaggcgtattaaatactttcgtgattttcttatctcgcgttatcgcaacggcggtagcaagttcgcgtaacaataatggagaagaaacgcgcagttcaggtatttatttcttggtttcgatggtattggaaatgctctttggtgtgcttgcaagtattatcgcaatgtggttctcgcgctaccgcgaatttcgtgcagatgcaggttccgcaagtttagtaggcaaagaaaagatgattatggcattgcaacgtttgcaacaacttcacgaaccccaaaatcttgaaggttctttaaatgcctttatgattaatggtaaacgcagtgaactctttatgagccatccaccactcgaaaagcgtattgaagccttacgtaatctttaa

SEQ ID NO: 534 - protein, 283 aa, Haemophilus influenzae
MMRILLFLATNMAVMLVLGIILSVTGIAGNSTGGILIMALLFGFAGSLISLFLSKTMALRSVDGEVITQPRNQTERWLIDTVSRQAQKAGIPMPDVAIYHSPDVNAFATGATKSNSLVAVSTGLLNNMTEAEAEAVLAHEISHISNGDMVTMALLQGVLNTFVIFLSRVIATAVASSRNNNGEETRSSGIYFLVSMVLEMLFGVLASIIAMWFSRYREFRADAGSASLVGKEKMIMALQRLQQLHEPQNLEGSLNAFMINGKRSELFMSHPPLEKRIEALRNL

SEQ ID NO: 535 - DNA, 861 bp, Pasteurella multocida
  CDS (1)..(861)
atgatgcgaattttgctatttcttgccacgaacatggcagttttagttgtttttaacattattttaagtttgacggggatccaagcacaagatgcgacagggctattgctcatggcggcattatttggtttttctggttctttaatttctctgtttttatctaaaaccatggctctacgcgctgtgggggcggaagtgatcaaacagccacgtaatgacatggaacgttggttagtgaatacagttcgttcgcaagctgaacgcgcgaatttaccgatgcctgatgtcgcgatttatcactctgaagatgtgaatgcgtttgcgacaggaccaagtaaaaataattccttagtggccgtgagtactggcttattacgtgccatgacacaagatgaagcagaagcagtacttgcgcatgaagtggcacatattaaaaatggtgatatggtgaccatgaccttattacaaggtgtattgaacacattcgtgatttttgtgtcacgcatgatcgcgaaagtcgtgtcaagcaatcgagatggtgaaagtagcacagggatttattttcttgtgtctatggtcttggaaatcttatttggtttcttagccagcatgatcgccatgtggttctctcgctatcgagaatttcgtgcggatgcagggtctgcaaagttagtcggtaaacacaaaatgattgccgcgttacaacgtttgcaacgtttacatgaaccacaagagttagaaggacagcttgccgcttttgcgattaacggtaaacgtggtggtttagcggctttatttatgagccatccgccattagaaaaacgtattgcggcattacaacaattagatagttttaaataa

SEQ ID NO: 536 - protein, 286 aa, Pasteurella multocida
MMRILLFLATNMAVLVVFNIILSLTGIQAQDATGLLLMAALFGFSGSLISLFLSKTMALRAVGAEVIKQPRNDMERWLVNTVRSQAERANLPMPDVAIYHSEDVNAFATGPSKNNSLVAVSTGLLRAMTQDEAEAVLAHEVAHIKNGDMVTMTLLQGVLNTFVIFVSRMIAKVVSSNRDGESSTGIYFLVSMVLEILFGFLASMIAMWFSRYREFRADAGSAKLVGKHKMIAALQRLQRLHEPQELEGQLAAFAINGKRGGLAALFMSHPPLEKRIAALQQLDSFK

SEQ ID NO: 537 - DNA, 879 bp, Buchnera aphidicola subsp Schizaphis graminum
  CDS (1)..(879)
atgatacgtattattcttttcttattaactaatttagcagttatgctaacattcagtctgattcttgctgtgacaggaattcagtctgaaagtatttacggtctattgattatgtcaagtctatttggttttagtggatctatcttatcacttattatgtctaaatggattgcattgcgttctgtaaatggtagaatcattaatcatcctagcaatgaaacagaaagttggctaattgatactattcgtcaacaatctataaaaaaaaatattattatgccacaaatagcaatatatgaagctgctgatatcaatgcatttgctacaggtgctcgtcgtaatgcagctttgattgctatatcaacaggattactagaaaatatgacacgtagtgaggcagaagcagtaattgctcatgaaattagtcatgtttcaaatggtgatatgatcacaatgactttagttcaaggtgttgtaaacacttttgtaatctttatatctcgtattatttcacaagcattgagcagcttattatcgagtaatagaaatgaaaatagtgaagatgaaaaagattcatttttattttttttaatttctacatttctagaaataatttttggtgtacttgcaagtattattactatgtggttttctagacatcgagaattttatgctgacgcaagttcagcaaaattagtcggaaaagaaaaaatgatttctgccctaaatcgtttaaagtcaagtcatgagcctcaagaatcagatagcataattgcattttgtattaacggaaaatctaattcatttatagaattattcgcctcccatccatctttagaaaaaagaatacaggcgctaaaaaataaaaaatatatgtaa

SEQ ID NO: 538 - protein, 292 aa, Buchnera aphidicola subsp Schizaphis graminum
MIRIILFLLTNLAVMLTFSLILAVTGIQSESIYGLLIMSSLFGFSGSILSLIMSKWIALRSVNGRIINHPSNETESWLIDTIRQQSIKKNIIMPQIAIYEAADINAFATGARRNAALIAISTGLLENMTRSEAEAVIAHEISHVSNGDMITMTLVQGVVNTFVIFISRIISQALSSLLSSNRNENSEDEKDSFLFFLISTFLEIIFGVLASIITMWFSRHREFYADASSAKLVGKEKMISALNRLKSSHEPQESDSIIAFCINGKSNSFIELFASHPSLEKRIQALKNKKYM

SEQ ID NO: 539 - DNA, 870 bp, Haemophilus ducreyi
  CDS (1)..(870)
atgtcaaaaagagtgattttatttttattaactaacttagccattacttttgtacttggtatcgtattgaatattatttttcaagtgacaggtattaaaggcacaagtacgaccggtattttaatgatgtctttgttatttggttttaccggatcgttaatttcgctatttatgtcaaaatcgatggcattacgttctgtaggcgctgaagtgattcaacaaccgagaaaccaagcagaacagtggttatttaatacggtgcaacgtcaatcacaaaaagcaggtattccaatgccagatattgccatttatcattctgctgatgtcaatgcgtttgcaacgggtgcgactaaaaataattctttagtcgcggtgagtaccggtctgttagataatatgactgaagatgaagctgaggcggtcgtagcacatgaaattgcgcatattgctaatggtgatatggtcacaatgactttattgcaaggcgtgctaaacacgtttgtgatttttttatctagaatgatttcaacggcggtttcaggctcacgtgatgaaaatggcaattcaactcaaaatacattagtgttttgggtagtggatattgcactacaaatgattttcggcatattagcgacaatgattgctatgtggttttcacgttatcgagaatatcgtgcagatatgggctcggcacaattagttggcaaagagaaaatgattgccgctttagagcgcctaagacatgtacacgaaccacaagaaatgcaaggttcattatctgcatttatgatcaatggtattcgttctaaagagttgtttatgagtcatccaccgcttgaaaagcgcattgaagcattgagaaatttataa

SEQ ID NO: 540 - protein, 289 aa, Haemophilus ducreyi
MSKRVILFLLTNLAITFVLGIVLNIIFQVTGIKGTSTTGILMMSLLFGFTGSLISLFMSKSMALRSVGAEVIQQPRNQAEQWLFNTVQRQSQKAGIPMPDIAIYHSADVNAFATGATKNNSLVAVSTGLLDNMTEDEAEAVVAHEIAHIANGDMVTMTLLQGVLNTFVIFLSRMISTAVSGSRDENGNSTQNTLVFWVVDIALQMIFGILATMIAMWFSRYREYRADMGSAQLVGKEKMIAALERLRHVHEPQEMQGSLSAFMINGIRSKELFMSHPPLEKRIEALRNL

SEQ ID NO: 541 - DNA, 879 bp, Xanthomonas campestris pv campestris
  CDS (1)..(879)
atgttcaaccgtgtcgtcctgtttctcttgaccaactttgcggtgctgatcctggccggcattgtgatgtcggtgctgggcgtgaatccgacacagatgagtggcctgctggtgatggccgccatcttcggcttcggcggctcgttcatttcgttgctgctgtccaagttcatggccaagcgcagcaccggcgcgcaggtgatcaccgagccgcggacgcagaccgagcgctggctggtggacacggtgcgccgccaggcccaggcggccggtatcggcatgccggaagtggccatctacgacggaccggaaatcaacgccttcgccaccggtgccaaccgcaacaatgcgctggtggcggtttccacgggcttgctgcagcacatgcgcgaagacgaggccgaggccgtgctgggccacgagattgcccacattgccaatggcgacatggtcaccatggccttgctgcagggcgtgctgaacaccttcgtgatcgtgctggcgcgcgtggtgggcggcatcatcgacagcgcgctgtctggcaatcgcgacagcgggcgtggatttgcctactacatcattgtgttcgtgctggagatggtgttcggcctgttcgccacgatgatcgcgatgtggttctcgcgccgccgcgagttccgtgccgatgccggtggcgcgcagctggccgggcgcaacaagatgatcgccgcattggagcgcctatcgctcaatcacggccagaacaccttgccctcgcaggtgcaggcgttcggcatttccggcggtgtgggtgagggcttgcgtcgcctgttcctgagccacccgccgctgaccgagcgcattgccgccttgcgtgcgtccaacggtacggcgatgtaa

SEQ ID NO: 542 - protein, 292 aa, Xanthomonas campestris pv campestris
MFNRVVLFLLTNFAVLILAGIVMSVLGVNPTQMSGLLVMAAIFGFGGSFISLLLSKFMAKRSTGAQVITEPRTQTERWLVDTVRRQAQAAGIGMPEVAIYDGPEINAFATGANRNNALVAVSTGLLQHMREDEAEAVLGHEIAHIANGDMVTMALLQGVLNTFVIVLARVVGGIIDSALSGNRDSGRGFAYYIIVFVLEMVFGLFATMIAMWFSRRREFRADAGGAQLAGRNKMIAALERLSLNHGQNTLPSQVQAFGISGGVGEGLRRLFLSHPPLTERIAALRASNGTAM

SEQ ID NO: 543 - DNA, 879 bp, Xanthomonas axonopodis pv citri
  CDS (1)..(879)
atgttcaaccgcattttcctgttcctgctgaccaatcttgcggtgctgatgctcgccggcatcgtcatgtcgttgcttggcgtcaatcccgcgcagatgagtggcctgttggtgatggccgccatcttcggtttcggcggctcgttcatttccttgctgctgtccaagttcatggccaagcgcagcaccggtgcgcaggtcatcaccgagccgcgcacgccgaccgaacgctggttgctggagaccgtgcgccgtcaggcccaggctgccggtatcggcatgccggaagtagcggtctacgagggaccggaaatcaacgcgttcgccaccggcgccaaccgcaacaacgcccttgtggcggtgtccaccggcctgctgcagaacatggaccaggatgaagccgaagcggtgcttggccacgagatcgcccacgttgccaatggcgacatggtcaccatggcactgctgcagggcgtactcaataccttcgtgatcgtgctcgcccgcgtggtcggcggcatcatcgacagcaccttgtcgggcaaccgcgaaggcggtcgtggctttgcgtactacatcatcgtgtttgcgttggagatggtgttcggcctgttcgcgaccatgattgcgatgtggttctcgcgacgccgcgaattccgcgccgatgccggtggcgcgcagctggccggccgcagcaagatgatcgctgcactggagcggctgtcgctcaaccatggccagaacaccttgccctcgcaagtgcaggcgttcggcatctccggcggggtgggcgagggcttgcgccgcctgttcctgagccatccgccgctcacagaacgcatcgctgcgctgcgcgcggccagcggtagcgccaggtaa

SEQ ID NO: 544 - protein, 292 aa, Xanthomonas axonopodis pv citri
MFNRIFLFLLTNLAVLMLAGIVMSLLGVNPAQMSGLLVMAAIFGFGGSFISLLLSKFMAKRSTGAQVITEPRTPTERWLLETVRRQAQAAGIGMPEVAVYEGPEINAFATGANRNNALVAVSTGLLQNMDQDEAEAVLGHEIAHVANGDMVTMALLQGVLNTFVIVLARVVGGIIDSTLSGNREGGRGFAYYIIVFALEMVFGLFATMIAMWFSRRREFRADAGGAQLAGRSKMIAALERLSLNHGQNTLPSQVQAFGISGGVGEGLRRLFLSHPPLTERIAALRAASGSAR

SEQ ID NO: 545 - protein, 136 aa, Consensus
  misc_feature (2)..(4): Xaa can be any naturally occurring amino acid
  misc_feature (6)..(8): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(20): Xaa can be any naturally occurring amino acid
  misc_feature (23)..(24): Xaa can be any naturally occurring amino acid
  misc_feature (26)..(33): Xaa can be any naturally occurring amino acid
  misc_feature (35)..(36): Xaa can be any naturally occurring amino acid
  misc_feature (38)..(41): Xaa can be any naturally occurring amino acid
  misc_feature (43)..(43): Xaa can be any naturally occurring amino acid
  misc_feature (46)..(47): Xaa can be any naturally occurring amino acid
  misc_feature (49)..(51): Xaa can be any naturally occurring amino acid
  misc_feature (53)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(71): Xaa can be any naturally occurring amino acid
  misc_feature (78)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (93)..(94): Xaa can be any naturally occurring amino acid
  misc_feature (96)..(98): Xaa can be any naturally occurring amino acid
  misc_feature (104)..(105): Xaa can be any naturally occurring amino acid
  misc_feature (108)..(109): Xaa can be any naturally occurring amino acid
  misc_feature (111)..(112): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
  misc_feature (132)..(134): Xaa can be any naturally occurring amino acid
  misc_feature (136)..(136): Xaa can be any naturally occurring amino acid
GXXXMXXXFGFXGXXXSLXXSKXXAXXXXXXXXIXXPXXXXEXWLXXTXXXQXXXXXXXMPXXAXYXXXXXNAFATGXXXXXXLXAXSTGLLXXMXXXEAEAVXXHEXXHXXNGDMXTMXLXQGVXNTFVIXXXRX

SEQ ID NO: 546 - protein, 46 aa, Consensus
  misc_feature (1)..(1): Xaa can be any naturally occurring amino acid
  misc_feature (3)..(5): Xaa can be any naturally occurring amino acid
  misc_feature (8)..(9): Xaa can be any naturally occurring amino acid
  misc_feature (11)..(12): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (23)..(24): Xaa can be any naturally occurring amino acid
  misc_feature (27)..(29): Xaa can be any naturally occurring amino acid
  misc_feature (31)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid
XLXXXFGXXAXXIXMWXSRXREXXADXXXAXXXGXXKMIXALXRLX

SEQ ID NO: 547 - protein, 301 aa, Consensus
  misc_feature (1)..(3): Xaa can be any naturally occurring amino acid
  misc_feature (5)..(6): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(30): Xaa can be any naturally occurring amino acid
  misc_feature (32)..(38): Xaa can be any naturally occurring amino acid
  misc_feature (41)..(42): Xaa can be any naturally occurring amino acid
  misc_feature (44)..(46): Xaa can be any naturally occurring amino acid
  misc_feature (50)..(50): Xaa can be any naturally occurring amino acid
  misc_feature (52)..(54): Xaa can be any naturally occurring amino acid
  misc_feature (57)..(58): Xaa can be any naturally occurring amino acid
  misc_feature (61)..(61): Xaa can be any naturally occurring amino acid
  misc_feature (68)..(70): Xaa can be any naturally occurring amino acid
  misc_feature (73)..(74): Xaa can be any naturally occurring amino acid
  misc_feature (78)..(79): Xaa can be any naturally occurring amino acid
  misc_feature (81)..(81): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(94): Xaa can be any naturally occurring amino acid
  misc_feature (97)..(97): Xaa can be any naturally occurring amino acid
  misc_feature (100)..(101): Xaa can be any naturally occurring amino acid
  misc_feature (105)..(107): Xaa can be any naturally occurring amino acid
  misc_feature (109)..(109): Xaa can be any naturally occurring amino acid
  misc_feature (117)..(121): Xaa can be any naturally occurring amino acid
  misc_feature (131)..(131): Xaa can be any naturally occurring amino acid
  misc_feature (134)..(136): Xaa can be any naturally occurring amino acid
  misc_feature (142)..(142): Xaa can be any naturally occurring amino acid
  misc_feature (146)..(147): Xaa can be any naturally occurring amino acid
  misc_feature (149)..(150): Xaa can be any naturally occurring amino acid
  misc_feature (158)..(158): Xaa can be any naturally occurring amino acid
  misc_feature (160)..(160): Xaa can be any naturally occurring amino acid
  misc_feature (164)..(164): Xaa can be any naturally occurring amino acid
  misc_feature (171)..(171): Xaa can be any naturally occurring amino acid
  misc_feature (174)..(199): Xaa can be any naturally occurring amino acid
  misc_feature (201)..(206): Xaa can be any naturally occurring amino acid
  misc_feature (209)..(210): Xaa can be any naturally occurring amino acid
  misc_feature (213)..(213): Xaa can be any naturally occurring amino acid
  misc_feature (216)..(217): Xaa can be any naturally occurring amino acid
  misc_feature (219)..(219): Xaa can be any naturally occurring amino acid
  misc_feature (225)..(225): Xaa can be any naturally occurring amino acid
  misc_feature (229)..(229): Xaa can be any naturally occurring amino acid
  misc_feature (234)..(234): Xaa can be any naturally occurring amino acid
  misc_feature (236)..(236): Xaa can be any naturally occurring amino acid
  misc_feature (240)..(241): Xaa can be any naturally occurring amino acid
  misc_feature (248)..(248): Xaa can be any naturally occurring amino acid
  misc_feature (251)..(254): Xaa can be any naturally occurring amino acid
  misc_feature (256)..(264): Xaa can be any naturally occurring amino acid
  misc_feature (267)..(267): Xaa can be any naturally occurring amino acid
  misc_feature (269)..(269): Xaa can be any naturally occurring amino acid
  misc_feature (271)..(278): Xaa can be any naturally occurring amino acid
  misc_feature (281)..(282): Xaa can be any naturally occurring amino acid
  misc_feature (287)..(288): Xaa can be any naturally occurring amino acid
  misc_feature (291)..(291): Xaa can be any naturally occurring amino acid
  misc_feature (294)..(301): Xaa can be any naturally occurring amino acid
XXXRXXLFLXTNXAVXXXXXXXXXXXXXXXGXXXXXXXGLXXMXXXFGFXGXXXSLXXSKXMALRSVXXXVIXXPRNXXEXWLXXTVXXQXXXXGIXMPXXAIYXXXDXNAFATGAXXXXXLVAVSTGLLXNMXXXEAEAVXAHEXXHXXNGDMVTMXLXQGVXNTFVIFXSRXXXXXXXXXXXXXXXXXXXXXXXXXXYXXXXXXLEXXFGXLAXXIXMWFSRXREFXADAGXAXLVGXXKMIAALXRLXXXXEXXXXXXXXXAFXIXGXXXXXXXXLFXXHPPLXXRIXALXXXXXXXX

SEQ ID NO: 548 - DNA, 1182 bp, Escherichia coli
  CDS (1)..(1182)
atgcataactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattgggattctggtaagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggtgtgatggtgtggctgtttttaccgtcgatgcgaaaagagcttccgctggcgaccggcacgatcgaagcgccgcgccgtaaccgtcgcgatacgctgctgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatctgatgcccggtcaggcgggttcagccaccacgctctataccaacacttcgcgcgtgggctggatcatcgcaggatcagtggcgggcatcgtcgccgagatctggaattatcacgctgtgttctggtttgcgatggtgatgattatcgccactctgttttgcttactgcggattaaagatgtttaa

SEQ ID NO: 549 - protein, 393 aa, Escherichia coli
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMRKELPLATGTIEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 550 - DNA, 21 bp, Primer
atgcataactcccccgcagtc

SEQ ID NO: 551 - DNA, 26 bp, Primer
ttaaacatctttaatccgcagtaagc

SEQ ID NO: 552 - DNA, 1332 bp, Helicobacter pylori
  CDS (1)..(1332)
atgtttaagaaaatttttccattagcgttagtgtcatcgttgcggtttttggggctttttattgttttgccggtcattagtttgtatgcggatagtttccattcaagcagtcccttactcgtggggttggctgtgggcggagcgtatcttacgcaaattgtttttcaaacccccatgggcattcttagcgataagataggccgtaaagtggtggttatggtgtgcttgctgttgtttttagccggctcgttagtgtgctttatagcgaatgatattgtttggctcgttatagggcgcttcattcaaggcatgggggctttagggggggttattagtgcgatggtggcggatgaagtgaaagaagaagagcgcaccaaagccatggccatcatgggagcgtttattttcattagcttcactataagcatggcgattggccctggggttgtagcgtttttggggggggcaaaatggctctttttactcacggcgatcttaactttattgagtttattgatgcttttaaaagtcaaagacgcccctaaaatttcttaccagatcaaaaacataaaagcttaccaacccaactctaaagccttgtatcttttgtatctaagctctttttttgaaaaagcgttcatgacgcttatttttgtgctgatccctttagccttagtgaatgaatttcataaagatgaaagctttttaatcttggtgtatgtgcctggagccttattaggggtcttaagcatgggaatagcgagcgttatggctgaaaaatacaacaagcctaaaggagtgatgctttctggcgtattattgtttattgtgagttatttgtgcttgtttttagccgactctagctttttagggaaatatttatggctttttattgttggggtggcgtttttctttattggttttgccaccttagagcctatcatgcaatctttagcgtctaaattcgccaaagtgcatgaaaaaggcaaggttttagggcaattcactacttttggctatttagggagctttgttgggggcgtgagcggggggttgagctaccatcatttaggcgtttctaacacaagcttgatcgttgtagctttagggcttatttgggggctatcgctctttttactcaacaacccttccaagcaaaaaaatgtctatttccccttagacgcttacaatgaggaacaatttgaaactttagaggataaaatcattgaatggtatgttaatattagcgaagaaatcattattgtgaaatataattccgatcacattagcgaagaagaaatcattcacttagcgcaaaactttagaaaataa

SEQ ID NO: 553 - protein, 443 aa, Helicobacter pylori
MFKKIFPLALVSSLRFLGLFIVLPVISLYADSFHSSSPLLVGLAVGGAYLTQIVFQTPMGILSDKIGRKVVVMVCLLLFLAGSLVCFIANDIVWLVIGRFIQGMGALGGVISAMVADEVKEEERTKAMAIMGAFIFISFTISMAIGPGVVAFLGGAKWLFLLTAILTLLSLLMLLKVKDAPKISYQIKNIKAYQPNSKALYLLYLSSFFEKAFMTLIFVLIPLALVNEFHKDESFLILVYVPGALLGVLSMGIASVMAEKYNKPKGVMLSGVLLFIVSYLCLFLADSSFLGKYLWLFIVGVAFFFIGFATLEPIMQSLASKFAKVHEKGKVLGQFTTFGYLGSFVGGVSGGLSYHHLGVSNTSLIVVALGLIWGLSLFLLNNPSKQKNVYFPLDAYNEEQFETLEDKIIEWYVNISEEIIIVKYNSDHISEEEIIHLAQNFRK

SEQ ID NO: 554 - DNA, 1257 bp, Escherichia coli
  CDS (1)..(1257)
atgtatcagtcgcgattcacctgcacacgcaatgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatattcagcgccggaatactcggtttactacccggcgcgttggttggcggaatgctggcggaccgttatggtcgcaagcgcattttgattggctcagttgcgctgtttggtttgttctcgctggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacaggctgcgccaccactgcgtgcgttatttgcgccagaaacggcaaccgcgacgctgctgctgtggctgtgttatttcttcactctgctggtggtttacatgttgatcaactggctaccgctgcttttggtggagcaaggattccagccatcgcaggcggcaggggtgatgtttgcactgcaaatgggtgcggcgagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagtcggagattaagaatgcagccgtgtgccgatgcctaa

SEQ ID NO: 555 - protein, 418 aa, Escherichia coli
MYQSRFTCTRNEVHLMSTRTPSSSSSRLMLTIGLCFLVALMEGLDLQAAGIAAGGIAQAFALDKMQMGWIFSAGILGLLPGALVGGMLADRYGRKRILIGSVALFGLFSLATAIAWDFPSLVFARLMTGVGLGAALPNLIALTSEAAGPRFRGTAVSLMYCGVPIGAALAATLGFAGANLAWQTVFWVGGVVPLILVPLLMRWLPESAVFAGEKQAAPPLRALFAPETATATLLLWLCYFFTLLVVYMLINWLPLLLVEQGFQPSQAAGVMFALQMGAASGTLMLGALMDKLRPVTMSLLIYSGMLASLLALGTVSSFNGMLLAGFVAGLFATGGQSVLYALAPLFYSSQIRATGVGTAVAVGRLGAMSGPLLAGKMLALGTGTVGVMAASAPGILVAGLAVFILMSRRLRMQPCADA

SEQ ID NO: 556 - DNA, 1233 bp, Pyrococcus abyssi
  CDS (1)..(1233)
atgaggcccagggaactagcaatcctccagggacttcaagaaaagtctgggaagataaggaagattaccatgagaaagaacatcctaatgttcgccataggcatgttcttcgcggacttcgcctggggattgggttttccctacctaggggtctacatgaagctcataggcggaacgatgtttctcgtcggcttactgagtgtagtctataatttaacatccacgatatttcaatatcccttcggttacctctcggataaaaccggaaagaggaagccattcataatcctgggcatcctggcctctggaacaacgtatggtttggtagctctcattacaagtccgatcctcctcctgggattgagggcatttcagggagctttaggagcgtcccttgctccagcgcattcagccttaatctccgagctctctcccaggataggctccatgttcgggttctttggattcgtggaaaacctaggcttcatggccggaaattttgccggaggctacatagttaagacccttggaatgaagatgatgttcataataacatccctggtctctctcattggaatattgttcctattgaagattaaggagagggggagggcaaaggctggtggagataggctaattatagtgaaggagggccgagagtcagatagggttgagctgaaggagattgcctttaagaagctaatgaagggtagactagggatattttacgtggcagttctgttggcgatgatagcctcaggggcggtttatgccacggtctcggtttactttgaagagaaatttggagaggagttcgtcgggtacctattcgggatagactcattgtccgcggccttgagcgccttgataatcggaaggctcatagataagtacggagagaagctgttcttcaggttatcattagtcggttacattataacattcatgggctatgctctcgccaacagcgttattataatggccctaatatcaatactctcaggccttaagtggactatgctgacgaattcatcctcaacgtacgttgccagaagggttccaacttcggagaggggacagggtatgggtctactcaacacaatgatgacccttggatgggtaattgggcccctgataggtggaattttagcagataatttcggattcgctgttatgctttactcgacggtgccaattctcttcctaggattcttgctttcttttaggatttaa

SEQ ID NO: 557 - protein, 410 aa, Pyrococcus abyssi
MRPRELAILQGLQEKSGKIRKITMRKNILMFAIGMFFADFAWGLGFPYLGVYMKLIGGTMFLVGLLSVVYNLTSTIFQYPFGYLSDKTGKRKPFIILGILASGTTYGLVALITSPILLLGLRAFQGALGASLAPAHSALISELSPRIGSMFGFFGFVENLGFMAGNFAGGYIVKTLGMKMMFIITSLVSLIGILFLLKIKERGRAKAGGDRLIIVKEGRESDRVELKEIAFKKLMKGRLGIFYVAVLLAMIASGAVYATVSVYFEEKFGEEFVGYLFGIDSLSAALSALIIGRLIDKYGEKLFFRLSLVGYIITFMGYALANSVIIMALISILSGLKWTMLTNSSSTYVARRVPTSERGQGMGLLNTMMTLGWVIGPLIGGILADNFGFAVMLYSTVPILFLGFLLSFRI

SEQ ID NO: 558 - DNA, 1176 bp, Pseudomonas aeruginosa
  CDS (1)..(1176)
atggaccttcgcttgctgttgctatccctgaccaccttcgccgccggcctggcggaaagcatcctgatcggcatcctgccgcccctggccgaagacctgcgggtctccatcagcctggccggccagctcaccaccctgttctccctcggcttcgccctcgccgcaccgctgctcggctggctgacccggcgcatcgaacgccgccgcctgctgctggcgaccctgctgctgttcgccctcagcaacgcgctcgccgccctcgctccgggctatctcggcctgctcctggctcgcctgggaatgtcggcctgttgcgggctgctgatcgtcctcgccagcctgctcgccgccgagctggccgccccggcccagcgcggccgggcgatcggcctgatcttcatgggcatcagcggttcgctggtgttcggcgtgccactgggcgtacagatcagcgactggttcggctggcgctggatcttcgccggcatcgcggtctattcgctgcccttgtgcctgctgctctggcgctacctgccgcaacgccaggccggcgacctgcccggccgcgaaggctacctgcggcagttgcgccagcccgcgctgtggctcgcgcaactggtatcgatcctgttgctcggcgggcacttcaccctgttcgcctatttcaccccgtacctggcgagcatggccggtattcgctcgcccagcgagatcagcctgatcctcctgctgatcggcctggcagcgctgagcggcggctatatcggcggctggctggccgaccacctcggccaccggcgcgccctgcgtctggtgccggcggccttcgccctggcgctggcggcggtgccgctgagcctgggcagcatcgggttcctgccggtactgatggtctggagcgcgatcagctggatgatctcgccggtggtgcagagcttcctgctgcgcagcgatccggccagcggttccgccggcgtcgccctgaacacctcggccatgcacctgggcgtgggcctcggcgcggcgctgggcggcctggtggtggcggcactgggagtcgccgcgacgccctgggtcggcctcgccctggtgctggcggcgctggcctgcgcgcttggcgccagcacgctggatggcgccacgcaagcgctgccgttcagtccccctgcacggtaa

SEQ ID NO: 559 - protein, 391 aa, Pseudomonas aeruginosa
MDLRLLLLSLTTFAAGLAESILIGILPPLAEDLRVSISLAGQLTTLFSLGFALAAPLLGWLTRRIERRRLLLATLLLFALSNALAALAPGYLGLLLARLGMSACCGLLIVLASLLAAELAAPAQRGRAIGLIFMGISGSLVFGVPLGVQISDWFGWRWIFAGIAVYSLPLCLLLWRYLPQRQAGDLPGREGYLRQLRQPALWLAQLVSILLLGGHFTLFAYFTPYLASMAGIRSPSEISLILLLIGLAALSGGYIGGWLADHLGHRRALRLVPAAFALALAAVPLSLGSIGFLPVLMVWSAISWMISPVVQSFLLRSDPASGSAGVALNTSAMHLGVGLGAALGGLVVAALGVAATPWVGLALVLAALACALGASTLDGATQALPFSPPAR

SEQ ID NO: 560 - DNA, 1332 bp, Helicobacter pylori
  CDS (1)..(1332)
atgtttaaggaaatgtttccattagcgttagtgtcgtcgttgcggtttttagggctttttatcgttttgcctgtcatcagttggtatgcggatagtttccattcaagcagtcctttgctcgtgggtttggcggtgggtggcgcgtatctcacgcaaatcatttttcaaacccccatgggcattcttagcgataaaatcggccgtaaagtggtcgttatggtgtgcttgttattgtttttaattggctcgttagtgtgctttgtggcgaacgatattatcacgctcgttatcgggcgcttcattcaaggcatgggggctttagggggggtcgttagcgcgatggtggcggatgaggtgaaagaagaagagcgcaccaaagcgatggcgatcatgggggcgtttattttcattagctttaccataagcatggcgataggccctggggttgtggcgtttttggggggggcaaaatggctcttcttgctcacggcgatcttaaccttattgagtttattgatgcttttaaaagtcaaagacgctcccaaaatttcttaccaaatcaaaaacataaaagcttatcaacccaactctaaagccttgtatcttttgtatctaagctctttttttgaaaagatgttcatgacgcttatttttgtattaatccctttagccttagtgaatgaattccataaagatgaaagctttttgatcttagtgtatgtgcctggagccttgttaggggttttaagcatgggaatagcgagcgttatggctgaaaaatacaacaagcctaagggggtgatgctttctggcgtgctgttgtttattgtgagttatttgtgcttgtttttagcggactctagctttttgggtaaatatttatggctttttattgttggggtggcgtttttctttattggttttgccaccttagagccgatcatgcaatctttagcgtctaagttcgctaaagtgcatgaaaaaggcaaggttttagggcaattcactacttttggctatttagggagctttgttgggggcgtgagtggggggttgagttatcatcatttaggcgtttctaacacgagtctaatcattgtagctttagggcttatttggggcttatcgctctttttgctccataacccttccaagcaaaaaaatgtctatttccctttagacgcttataatgaggaacaatttgaaactttaggggacaaaatcattgaatggtatgtcaatattagcgaagaaatcatcattgtgaaatataattctgatcatatcagcgaagaaggaatcattcacttagcgcaaaactttagaaaataa

SEQ ID NO: 561 - protein, 443 aa, Helicobacter pylori
MFKEMFPLALVSSLRFLGLFIVLPVISWYADSFHSSSPLLVGLAVGGAYLTQIIFQTPMGILSDKIGRKVVVMVCLLLFLIGSLVCFVANDIITLVIGRFIQGMGALGGVVSAMVADEVKEEERTKAMAIMGAFIFISFTISMAIGPGVVAFLGGAKWLFLLTAILTLLSLLMLLKVKDAPKISYQIKNIKAYQPNSKALYLLYLSSFFEKMFMTLIFVLIPLALVNEFHKDESFLILVYVPGALLGVLSMGIASVMAEKYNKPKGVMLSGVLLFIVSYLCLFLADSSFLGKYLWLFIVGVAFFFIGFATLEPIMQSLASKFAKVHEKGKVLGQFTTFGYLGSFVGGVSGGLSYHHLGVSNTSLIIVALGLIWGLSLFLLHNPSKQKNVYFPLDAYNEEQFETLGDKIIEWYVNISEEIIIVKYNSDHISEEGIIHLAQNFRK

SEQ ID NO: 562 - DNA, 1185 bp, Escherichia coli
  CDS (1)..(1185)
atgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcggactgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttaa

SEQ ID NO: 563 - protein, 394 aa, Escherichia coli
MQKTATTPSKILDLTAAAFLLVAFLTGIAGALQTPTLSIFLADELKARPIMVGFFFTGSAIMGILVSQFLARHSDKQGDRKLLILLCCLFGVLACTLFAWNRNYFILLSTGVLLSSFASTANPQMFALAREHADRTGRETVMFSTFLRAQISLAWVIGPPLAYELAMGFSFKVMYLTAAIAFVVCGLIVWLFLPSIQRNIPVVTQPVEILPSTHRKRDTRLLFVVCSMMWAANNLYMINMPLFIIDELHLTDKLTGEMIGIAAGLEIPMMLIAGYYMKRIGKRLLMLIAIVSGMCFYASVLMATTPAVELELQILNAIFLGILCGIGMLYFQDLMPEKIGSATTLYANTSRVGWIIAGSVDGIMVEIWSYHALFWLAIGMLGIAMICLLFIKDI

SEQ ID NO: 564 - DNA, 1179 bp, Escherichia coli
  CDS (1)..(1179)
atgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggagcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttaa

SEQ ID NO: 565 - protein, 392 aa, Escherichia coli
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALEREYADNSAREVVMFSSVMRAQLSLAWVIGPPLAFMLALNYGFTVMFSIAAGIFTLSLVLIAFMLPSVARVELPSENALSMQGGWQDSNVRMLFVASTLMWTCNTMYIIDMPLWISSELGLPDKLAGFLMGTAAGLEIPAMILAGYYVKRYGKRRMMVIAVAAGVLFYTGLIFFNSRMALMTLQLFNAVFIGIVAGIGMLWFQDLMPGRAGAATTLFTNSISTGVILAGVIQGAIAQSWGHFAVYWVIAVISVVALFLTAKVKDV

SEQ ID NO: 566 - DNA, 1182 bp, Escherichia coli
  CDS (1)..(1182)
atgatcaactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattggggttctggtgagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcatttattgtttgcggcgtgatggtgtggctgtttttaccgtcgatgcaaaaagagcttccgctggcgaccggcacggttgaagcgccgcgccgtaaccgtcgcgatacgctgctgctgtttgtcatttgtacattgatgtggggctcgaacagcctgtacatcatcaacatgccgctatttattatcaacgaactccatcttcccgagaaactggccggtgtgatgatggggaccgccgccgggctggaaatcccgaccatgttgattgccggatatttcgccaaacgtctgggtaagcgtttcttaatgcgcgttgctgccgtgggtggcgtctgtttttacgcaggaatgctgatggcgcattctcctgtcattctgttgggcttgcagctgctaaatgctatttttattggcattctgggcggtatcgggatgctctattttcaggatctgatgcccggtcaggcaggttcagccaccacgctctataccaacacgtcgcgcgtgggctggatcatcgcgggatcagtggcgggcatcgtcgccgagatctggaattatcacgctgtgttctggtttgcgatggtgatgattatcgccactctgttttgcttactgcggattaaagatgtttaa

SEQ ID NO: 567 - protein, 393 aa, Escherichia coli
MINSPAVSSAKSFDLTSTAFLIVAFLTGIAGALQTPTLSIFLTDEVHARPAMVGFFFTGSAVIGVLVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 568 - DNA, 1188 bp, Escherichia coli
  CDS (1)..(1188)
atgaacttatccctacgacgctctaccagcgcccttcttgcctcgtcgttgttattaaccatcggacgcggcgccacgctgccatttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattcctttagtgaataacgtgacgctggtggtgctcttttttgccctcattaactgcgcctattccgtttttgctaccgtgctgaaagcctggtttgccgacaatctttcatccaccagcaaaacgaagatcttctcgatcaactacaccatgctcaatattggctggaccgtcggcccgccactcggcacgctgttggtcatgcagagcatcaatctgcccttttggctggccgctatctgctctgcgtttcccatgtttttcattcaaatttgggtaaagcgcagcgagaaaatcatcgccacggaaacaggcagtgtctggtcgccgaaagttttattacaagataaggcactgttgtggtttacctgctctggctttctggcttcttttgttagtggcgcatttgcttcatgcatttcacaatatgtgatggtgattgctgatggtgattttgccgaaaaggtggtcgcggttgttcttccagtgaatgctgccatggtggttacgttgcaatattccgtgggccgccgccttaacccggctaacatccgcgcgctgatgacagcaggcaccctctgtttcgtcatcggtctgatcggttttattttttccggcaacagcctgctattgtggggtatgtcagctgcggtatttactgtcggtgaaataatttatgcgccgggcgagtatatgttgattgaccatattgcgccgccaggaatgaaagccagctatttttccgcccagtcattaggctggttgggcgcagcggtaaatccattagtgagtggtgttgtacttaccactctcccgtcgtcttcgctgtttatcattctggcgttagtcatcattgccgcgtgggcgctgatgttaaaaggtattaacgccagaccccagaggcaaccagcactctgttaa

SEQ ID NO: 569 - protein, 395 aa, Escherichia coli
MNLSLRRSTSALLASSLLLTIGRGATLPFMTIYLSRQYSLSVDLIGYAMTIALTIGVVFSLGFGILADKFDKKRYMLLAITAFASGFIAIPLVNNVTLVVLFFALINCAYSVFATVLKAWFADNLSSTSKTKIFSINYTMLNIGWTVGPPLGTLLVMQSINLPFWLAAICSAFPMFFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLIGFIFSGNSLLLWGMSAAVFTVGEIIYAPGEYMLIDHIAPPGMKASYFSAQSLGWLGAAVNPLVSGVVLTTLPSSSLFIILALVIIAAWALMLKGINARPQRQPALC

SEQ ID NO: 570 - DNA, 1215 bp, Vibrio cholerae
  CDS (1)..(1215)
atgtatcgagataaaaccgccttactgtttattatgtcgacactggttacgggtctatgcggagcgtttttctatccactctccagtctgtttattgttgaggcgctcgatgcttcaccgatgcaactgagcctgtatatggtgttggcagtcgtcagctcagttatcgtgtcgcagtggcttgcacgccaatcagatcgtcattggcagcgtaaaaccatcttattggtttcgttaatctgttatctcatcactgtggtcagctttatgtttattcgcagctacagtctcgccatcatggtggtggtactgtttgctaacgtgagtggcgcgtcatttggtcagctttttgcgcttggccgcgaatacgccgatcagcatttaactgataaaacgaccttcctctctaccatgcgtgccggaattgcgattgcttgggtatttggccctccggcggcgtttatgcttaaagccagtttcggctttaatgccgcctttgcggtgtctgctctgatagtatttttaggcatagtgctgattgctcgcttcttgccagcaggggtgaaaaccgcctcagccgttggaaccacgccagtcgaacttggacaatattcaccccgtaagcgtgctttgatcgtactgtactgcgtgaccttggtatgtacttttggctcaaacaatctttatatcaccagtatgccgctctatttatcacgtgagttgatggtgcctgaacattggctagggttgctgtttggcacggccgcattgtgtgaaattccggtcatgttaatggcgggaaaacttgccgagcgatggggaacaaataaattgctgatgtttgggatcaccagcggcatcttgttttacggtgtgatgctgacccacactgggtttgttgccatgatggccgcgcaagtgctcaatggcttttttatcggcgtatgcgcgacgctaggcatggtggtgctgcaggacatgatgcaagaccgattgggcacggcttccaccttattttcgagcatgctcagtatcagtactttggtggcgagcttatcggttggcgtagtcggtgagttttataactatttcagtaccttgtatgtttctttaactggtgctttcagtgctttactgctgttggcgttgtttagtcaactgcagcgcaaagcaataccaaccgaagcggtgcaaagtggagtctcggttcattaa

SEQ ID NO: 571 - protein, 404 aa, Vibrio cholerae
MYRDKTALLFIMSTLVTGLCGAFFYPLSSLFIVEALDASPMQLSLYMVLAVVSSVIVSQWLARQSDRHWQRKTILLVSLICYLITVVSFMFIRSYSLAIMVVVLFANVSGASFGQLFALGREYADQHLTDKTTFLSTMRAGIAIAWVFGPPAAFMLKASFGFNAAFAVSALIVFLGIVLIARFLPAGVKTASAVGTTPVELGQYSPRKRALIVLYCVTLVCTFGSNNLYITSMPLYLSRELMVPEHWLGLLFGTAALCEIPVMLMAGKLAERWGTNKLLMFGITSGILFYGVMLTHTGFVAMMAAQVLNGFFIGVCATLGMVVLQDMMQDRLGTASTLFSSMLSISTLVASLSVGVVGEFYNYFSTLYVSLTGAFSALLLLALFSQLQRKAIPTEAVQSGVSVH

SEQ ID NO: 572 - DNA, 1170 bp, Deinococcus radiodurans
  CDS (1)..(1170)
atgccgcacgcgctaggcctcacgctcgcggtgctgctgctggggctggcgacctcgcttgccgggccgttcatgtcgctgtttgccgtgcagcaggtggggatgaccccgctgcaactggggctttttctgaccttcaacgccctgagcgccgtgctggtcagcacccggctggggcgctgggccgaccgccgcagcgaccgcaaaccgctggtgctgctcacgctggcggcgggcgtgctcgcctacctcgcgctgagcggcgtgcgctcggtctacggcgtgatggcgacgggcgtgctgctgctggcggtgagttcggcggcctttccgcaggtcttcgcctttgcccgctcgggcttcgcgcaggcgccgggtgacctgccggaaaaggcggtcacggtgctgcgggcagtcttttccttcgcctgggtggtggggccgggggtgggcgccgccgtgctgggccgctggtcgttcagcggggtgtttctgctcgcggcgctctgctacgcgctcgccgggctgcccctgctgtttattcgcccgcccgcgccagcccccgcacagccgaacagcgcgccctcgccgctcacccaggaactcggcgctccgcccgcgccgccgatgggctgggtggtggcggcgtttaccctctacggcatggcgatgcacatgggaatggtcatgttttcgttgttcgtgaccgaaaccctgcacggcaccagcgctcaggtgggctttctggtcggattgtgtgcactgctggaaatcccggtgatgctgctcttcgtcctttccaagcggctgccgggggtggagtggctcatcaaggccggcctgctgctgttcgtggtgcacttcgcgctgatttatctggcgcaggggatgccgctgctcatcgccacccaggtgctgcgcgccgccgtgctcgcggtgatggcggggctgggcatgacgtatttccagcagctcatgccggggcgcttcagcgcggccaccacgctgtattccaacacctcggtggtcggctccatgctttcgggcatcgtggcgggggcgtgggcgcaggtgttcggctaccgcccggtctttttgctgtgcgccgctctcagcctcgccgcctggggcatgatgctgtgggccacccggcgtccgaagctcgcctga

SEQ ID NO: 573 - protein, 389 aa, Deinococcus radiodurans
MPHALGLTLAVLLLGLATSLAGPFMSLFAVQQVGMTPLQLGLFLTFNALSAVLVSTRLGRWADRRSDRKPLVLLTLAAGVLAYLALSGVRSVYGVMATGVLLLAVSSAAFPQVFAFARSGFAQAPGDLPEKAVTVLRAVFSFAWVVGPGVGAAVLGRWSFSGVFLLAALCYALAGLPLLFIRPPAPAPAQPNSAPSPLTQELGAPPAPPMGWVVAAFTLYGMAMHMGMVMFSLFVTETLHGTSAQVGFLVGLCALLEIPVMLLFVLSKRLPGVEWLIKAGLLLFVVHFALIYLAQGMPLLIATQVLRAAVLAVMAGLGMTYFQQLMPGRFSAATTLYSNTSVVGSMLSGIVAGAWAQVFGYRPVFLLCAALSLAAWGMMLWATRRPKLA

SEQ ID NO: 574 - DNA, 1200 bp, Bacillus halodurans
  CDS (1)..(1200)
atgacccgttctgaacgaaaaccgttgctcatgctgatggtcaatatgtttgtcgtcatgatgggcatcggcttagttattcccattctaccttattatattgaagcattcggggcatcgagcgttgaactaggattgttaattgccatcttttcattcatgcaatttttgttggcccctttttggggaagactctctgataaagtggggcgaaagccgttaattgcggtaggtatgttcggctttgctgtagcagaatttatttttgcttttgccacacagttctggatgttgttcgtgtcccgaatacttgcaggggcatttggttcagcggttatgccagccgcgatggcgtatgtgtctgatcggacgagcgaagaaaaacgaggacatggcatggggctgcttggtgcgtctatggctctcggaattgtcgtcggcccagggattggtggttggctagcagaattcagcttagcgacaccatttttattcgctgggtttgcggcttctttcgctgccatattctcactcttatggcttcctgaatcgttaccgttagaaaagcgtaaaactgaagtggaacctgtgaaccaatttgtgcaaatgtggcaggcggtccgcagtcctatcggttttttgctctttcttgtgtttgggttgagctttggactagccaattttcaaacgatttttggcatctttgcccttcatcgctttcactataatccgagtgaagttggattcatcatggtgctcacagggatcgtaggtgcgatcgcccaaggcagtctagtaggaagattaactgaaagatatggagaggaaaaagtagtccttggttctctcagtctgagcggtatagggtttttaatcatgatgctagcatttaattattggacggttattgcaactacgtgcttgttctttttaggaaactcgattttgcgcccagccgttcaatcttttctatcgaaaatggcaggggatcagcaaggaatgatcatgggcttgaataactccattcttagtttaggaaacgtcgtaggagcccttctagcaggtttattatttgagtggaatatgtttctcccttacaccgttggcgcgttcgttatgtttgctagtttaggtgcaacctttcgttggttgtcaaaaagagcaagtcaagggaagcaccctgagaagtcgagcccgtaa

SEQ ID NO: 575 - protein, 399 aa, Bacillus halodurans
MTRSERKPLLMLMVNMFVVMMGIGLVIPILPYYIEAFGASSVELGLLIAIFSFMQFLLAPFWGRLSDKVGRKPLIAVGMFGFAVAEFIFAFATQFWMLFVSRILAGAFGSAVMPAAMAYVSDRTSEEKRGHGMGLLGASMALGIVVGPGIGGWLAEFSLATPFLFAGFAASFAAIFSLLWLPESLPLEKRKTEVEPVNQFVQMWQAVRSPIGFLLFLVFGLSFGLANFQTIFGIFALHRFHYNPSEVGFIMVLTGIVGAIAQGSLVGRLTERYGEEKVVLGSLSLSGIGFLIMMLAFNYWTVIATTCLFFLGNSILRPAVQSFLSKMAGDQQGMIMGLNNSILSLGNVVGALLAGLLFEWNMFLPYTVGAFVMFASLGATFRWLSKRASQGKHPEKSSP

SEQ ID NO: 576 - DNA, 1215 bp, Sinorhizobium meliloti
  CDS (1)..(1215)
atgtcttccccgctgttgatcgccatgcgcaatccggtcatccggacgagcatgatcgccatcgtcctgttcggtttttcgggggccgcgacgtcgccctaccaatcggtcgtcggcatcaccgaactgggattgagcgacgggttctattcggcgctgatcttcgcagcggcactggtcaatgttgcggtcagcgtgacgatcggcatcgtcgccgaccgcgtcggcaattaccggacactgatgctggcggtcattctctgcggggttgtcggttacggggcggtttatctgctgccgactaaggggagcttcgtacttgcggccctcatgctgttgcccgttcacggcgcactcaatccgctgctcttcgcctatgtccgcacggctgcgaaagagatgggcggcaggcatgcggctgcagtcaattccggcattcgtgcggccatatcgctctcctgggtattggttcccggactggtcggattggtgctgtcggcgcgcggcagcatgctgccggcctatcttctggcaagcctcggctgtctcgccaatttcgtgctcgtcttgcggctgctgccggaaaaggcgagcgtggacggtgctttgggcaaacgcctctcgtttctcgcgtccttcggcgagatattatcgctgcgcgttctggcacggcttctcgccatcgccctgatctcgtcaatgctgcacgtcactgcggcggtgctgccgctgatcgtcaccggtgcagccggcggcaaggtgagcgacatcggcatcatcgtcggtatcgtcgcttttctggaggtggtgttcatcgtggtctggggacgtatccagtaccggctcagccatatcgatgcgctcgcgctcggcacggcaatctatgtcctgaacatggccctgctcgggctttcgaccgagcgctggcacatttatgcgttgacgctcatcagcgctttcggcgcagcggcgctgatcagcatcccgatcacctatctgcaggaactgatcgcggaccggcccggtctgggcagttcgctgatctcggtgaacgtcttcctgggggcaggattcggcgccgctctttttgcgctcggaacgcgcatcagcgactattcgggaaccgcgcttctaagctcccttgcaggcatcgccgggctcttgctgctgcttttcctggatggcgaccgccgaggaaaagcgtctgcgtcctaa

SEQ ID NO: 577 - protein, 404 aa, Sinorhizobium meliloti
MSSPLLIAMRNPVIRTSMIAIVLFGFSGAATSPYQSVVGITELGLSDGFYSALIFAAALVNVAVSVTIGIVADRVGNYRTLMLAVILCGVVGYGAVYLLPTKGSFVLAALMLLPVHGALNPLLFAYVRTAAKEMGGRHAAAVNSGIRAAISLSWVLVPGLVGLVLSARGSMLPAYLLASLGCLANFVLVLRLLPEKASVDGALGKRLSFLASFGEILSLRVLARLLAIALISSMLHVTAAVLPLIVTGAAGGKVSDIGIIVGIVAFLEVVFIVVWGRIQYRLSHIDALALGTAIYVLNMALLGLSTERWHIYALTLISAFGAAALISIPITYLQELIADRPGLGSSLISVNVFLGAGFGAALFALGTRISDYSGTALLSSLAGIAGLLLLLFLDGDRRGKASAS

SEQ ID NO: 578 - DNA, 1188 bp, Escherichia coli
  CDS (1)..(1188)
atgaacttatccctacgacgctctaccagcgcccttcttgcctcgtcgttgttattaaccatcggacgcggcgctacgctgccatttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattactttagtgaataacgtgacgctggttgtgctcttttttgccctcattaactgcgcctattctgtttttgctaccgtgctgaaagcctggtttgccgacaatctttcgtccaccagcaaaacgaaaatcttctcaatcaactacaccatgctaaacattggctggaccatcggtccgccgctcggcacgctgttggtaatgcagagcatcaatctgcccttctggctggcagctatctgttccgcgtttcccatgcttttcattcaaatttgggtaaagcgcagcgagaaaatcatcgccacggaaacaggcagtgtctggtcgccgaaagttttattacaagataaagcactgttgtggtttacctgctctggttttctggcttcttttgtaagcggcgcatttgcttcatgcatttcacaatatgtgatggtgattgctgatggggattttgccgaaaaggtggtcgcggttgttcttccggtgaatgctgccatggtggttacgttgcaatattccgtgggccgccgacttaacccggctaacatccgcgcgctgatgacagcaggcaccctctgtttcgtcatcggtctggtcggttttattttttccggcaacagcctgctattgtggggtatgtcagctgcggtatttactgtcggtgaaatcatttatgcgccgggcgagtatatgttgattgaccatattgcgccgccagaaatgaaagccagctatttttccgcccagtctttaggctggcttggtgccgcgattaacccattagtgagtggcgtagtgctaaccagcctgccgccttcctcgctgtttgtcatcttagcgttggtgatcattgctgcgtgggtgctgatgttaaaagggattcgagcaagaccgtgggggcagcccgcgctttgttaa

SEQ ID NO: 579 - protein, 395 aa, Escherichia coli
MNLSLRRSTSALLASSLLLTIGRGATLPFMTIYLSRQYSLSVDLIGYAMTIALTIGVVFSLGFGILADKFDKKRYMLLAITAFASGFIAITLVNNVTLVVLFFALINCAYSVFATVLKAWFADNLSSTSKTKIFSINYTMLNIGWTIGPPLGTLLVMQSINLPFWLAAICSAFPMLFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLVGFIFSGNSLLLWGMSAAVFTVGEIIYAPGEYMLIDHIAPPEMKASYFSAQSLGWLGAAINPLVSGVVLTSLPPSSLFVILALVIIAAWVLMLKGIRARPWGQPALC

SEQ ID NO: 580 - DNA, 1182 bp, Agrobacterium tumefaciens
  CDS (1)..(1182)
atgttacagaaaagcacgtcgccgggcgcttttgatcgtcaggcctatctgatcgcgctgctggttttcatcgccggcagcaccaatgcggctgtcgtgccgtttatcgggttttatatcattcaggtgctcggtcacccgccggccacgcttggtctctacagcgtgacggcgatggtggcgtcgatcatcgccagccgtttctatggcgagcgcgtggatgccggcgtgcgggtgcggccattgctgctgctctctgtgttcggtgcatttgtcgcagcggcggcagccacctccgggcacctggcattgctggtggcggtgacggcaacgggcatggggctttccaatgccgccagtaccctgattttcagttatggtcgctactatggccgggtaaatgcactggatgcgccttcatataacgccgtcctgcgcacaatggtgtcgctggcatggatgctgcttccggccgcggcctacctgatcctcgattttgccggggcgaaagcggtttttataaatgccatgatgatggcagccatctgggccgggctggcgctcgccatcgtgccgcgcggccagacctgtccgatggaacggcgggcagacggtgatgccgatacgcggcgcaacctgccgctgttgatggcggcggcggccagcttctgcatgtctttcgcccacgcgctctgcgcctcggccctgcctgtgtttctggtgcgcgaagtgggcctgccggactacgtgccgggcctgtcgctcagcgtcaaatgtgccatggaggttctgctgatcctgcttgcgccgaggatcatgcgccgggtcagcgcccggatcctgcttggcgtctctgcggtgatggcgatcatcgctttcaacatcatcgcttcggttcagactttgccggccatgcttttcggtgcggcaatggaaggcgcctattacgggttgtgcgccggcacctgcctgaccttcgtgcagggctttgcgcgcggccgcacggcgcgggcaaccgcgctctacatgaactccatcttccttgccggcctgtttgcggtgccattgatggggtttgtgtcgcaatatgcgagcttcggcacgtcgatccggctggcttcggttggtgcgggtgcggcgctgttgctgctgtttctgacgcgacggcaggtgagtgaataa

SEQ ID NO: 581 - protein, 393 aa, Agrobacterium tumefaciens
MLQKSTSPGAFDRQAYLIALLVFIAGSTNAAVVPFIGFYIIQVLGHPPATLGLYSVTAMVASIIASRFYGERVDAGVRVRPLLLLSVFGAFVAAAAATSGHLALLVAVTATGMGLSNAASTLIFSYGRYYGRVNALDAPSYNAVLRTMVSLAWMLLPAAAYLILDFAGAKAVFINAMMMAAIWAGLALAIVPRGQTCPMERRADGDADTRRNLPLLMAAAASFCMSFAHALCASALPVFLVREVGLPDYVPGLSLSVKCAMEVLLILLAPRIMRRVSARILLGVSAVMAIIAFNIIASVQTLPAMLFGAAMEGAYYGLCAGTCLTFVQGFARGRTARATALYMNSIFLAGLFAVPLMGFVSQYASFGTSIRLASVGAGAALLLLFLTRRQVSE

SEQ ID NO: 582 - DNA, 1206 bp, Agrobacterium tumefaciens
  CDS (1)..(1206)
atgccgtcggctctttccatcgtcatcaacaatccgtcgatccgcatcggggcgctcgccatcctgtttttcggcttttcgaatgcggcgaccgcgccctatcaggcggtcatcggtattcgtgaaatcgggctgagcaacagcgtctattcgttgctgatgctgtttgccgccgtcatcaatgtcagcgccagcgtgctgatgggcatcgtcgccgacaggctgggcgaataccgcaagcccatgctgctcatcgcgctcttcggcgtcagcggttatatgctggtttatctggtcggcaacgccacggctttcgtcagtgccaagcttattctgctgccgattttcggggcgatgaactcgctgatcttcgcgcatgtgcgcgccgatgcccgcaatctttcgacgggcgacatgatcgccgtgaattcgatcatgagggccaccatctcgctgtcctgggtactggtgcccggcattgttggcatttttctggtgaattccggcaatatgcttctggcgttcctgttttcgggtgtctgcgcgctcatctgtttcctgctggttgctttctgtctgccacgcgcggccacgccggcggtcgtcaataacgaagcgcgcttcggcctcatggcttcgcttgcggaaatcggatcgcggcgggtgcttttgcggatcatcgccatcgccctgatctgctccatgctgcatctgaatgattccatccgctcgctcatcatcaccggacaggcaaagggtacggttgcggatatcggtatcgtcgcgggtatcgtcgccgcgctggaaattgtcttcattctcctctggggctggatcgaaaagaaggtgccgcagacgctgacgctggcggcgggtgcggtgctttacgccatctatctcatcctgcaggggctcgcttccgcgccgtggcacatctacgcacagaccgtcatcagcgcgctcggtgccgccgccatcatcagcattcccatcacctacctgcaggaattgatcgccgatcgcccggggctcggaagctcgctgatcgcggtcaatatcttcctcggcgctggtctcggggcgctgatttttgccgtcggaaccttggtctccagctattcgggaacgtcgatactgggtgcgatcgtcggtctgggcggtgtttacatgctctacacgcttgatgggaccggccgccgcaggtaa

SEQ ID NO: 583 - protein, 401 aa, Agrobacterium tumefaciens
MPSALSIVINNPSIRIGALAILFFGFSNAATAPYQAVIGIREIGLSNSVYSLLMLFAAVINVSASVLMGIVADRLGEYRKPMLLIALFGVSGYMLVYLVGNATAFVSAKLILLPIFGAMNSLIFAHVRADARNLSTGDMIAVNSIMRATISLSWVLVPGIVGIFLVNSGNMLLAFLFSGVCALICFLLVAFCLPRAATPAVVNNEARFGLMASLAEIGSRRVLLRIIAIALICSMLHLNDSIRSLIITGQAKGTVADIGIVAGIVAALEIVFILLWGWIEKKVPQTLTLAAGAVLYAIYLILQGLASAPWHIYAQTVISALGAAAIISIPITYLQELIADRPGLGSSLIAVNIFLGAGLGALIFAVGTLVSSYSGTSILGAIVGLGGVYMLYTLDGTGRRR

SEQ ID NO: 584 - DNA, 1182 bp, Yersinia pestis
  CDS (1)..(1182)
atgagatctgcacgagccttttcccgtcgtatcaacccggttttcctcgctttctttgtggtggcttttctttccggcatcgcgggtgcgttgcaagccccgacattaagcctgtttttaagcacagagttaaaagtgcgtccgctgtgggtcggattgttttataccgtgaatgccattgccggtatcaccgtgagcttcctactggccaaacgctcagatctgggcggggatcggcgtaaattaattctgatctgctatctgatggcggtcggaaattgcctgctattcgcttttaatcgtgattatctgacgttgatcactttaggtgttttgatggcctcggtggcgaataccgcgatgccgcaaattttcgccttggcacgggaatatgcggataactctgcgcgtgaagtggtgatgttcagttcgattatgcgtgcgcaattatcattggcttgggttatcgggccaccgctgtcatttatgttagcgctgaattatggctttacgctgatgtttagcattgccgccggtatttttgttattagtgcgctggtggtctggtttatcctgccgtcggttaaacagcctgagcccgtagccgatgcccccgtggtggtacaaggcagtttgtttgccgataaaaatgtcttactgctgttcattgcctcaatgctgatgtggacgtgtaataccatgtacatcattgatatgccgctctatatcaccgctaatttagggttgcctgagcgtttggcgggtttgctgatggggaccgccgccgggctggaaattcctatcatgttgttggcaggttactcggttaggcgctttggtaaacgtaaaatcatgctgtttgcggtgatggcgggggtgctgttttataccgggctggtgctgtttaaattcaaaaccgcactgatgatattgcagatttttaatgccatctttatcggcatcgtcgccggtattggtatgctctattttcaggatctcatgccggggcgggcaggtgccgcaaccacgttatttaccaacagtatttctagtggggtgattttggccggtgtgctgcaaggtgtattgactgaaacctgggggcataatgcggtttatgtcgctgcgatggtgttggttattttggcgttgatcatctgcgccaaagtgagagaggcttag

SEQ ID NO: 585 - protein, 393 aa, Yersinia pestis
MRSARAFSRRINPVFLAFFVVAFLSGIAGALQAPTLSLFLSTELKVRPLWVGLFYTVNAIAGITVSFLLAKRSDLGGDRRKLILICYLMAVGNCLLFAFNRDYLTLITLGVLMASVANTAMPQIFALAREYADNSAREVVMFSSIMRAQLSLAWVIGPPLSFMLALNYGFTLMFSIAAGIFVISALVVWFILPSVKQPEPVADAPVVVQGSLFADKNVLLLFIASMLMWTCNTMYIIDMPLYITANLGLPERLAGLLMGTAAGLEIPIMLLAGYSVRRFGKRKIMLFAVMAGVLFYTGLVLFKFKTALMILQIFNAIFIGIVAGIGMLYFQDLMPGRAGAATTLFTNSISSGVILAGVLQGVLTETWGHNAVYVAAMVLVILALIICAKVREA

SEQ ID NO: 586 - DNA, 1212 bp, Thermoplasma acidophilum
  CDS (1)..(1212)
atgatcggtgggaatgcgccggcaccatactacaggaacaggtctctgtggggagttagcattgcagcctcggtaagatccataggttacggtgcaacatggccgtttcttgccgtgtacttcaacacgtatcttcacatgagcctattgttcgttggccttatattcacgctgaactccggcatttccatagtcttcagcctgtttgccggctacatggcagccgcattcggaaggaaattcacactcgtgctgggaaacgtggccggttttatcctgtacttgctgctgtcgatcttttctggaaaaaacgtagcgatcatatcgacactcttcgtgctgacggcgttttccggatcgctagtcttcccctctgcaaactcaatagtttcagatataacctcgagcatggatcgtgaaatgggatatgcaatctacaggataatggcaaaccttggctgggccataggccctctcataagtgcaatcatattctcctatggtttcggcttcatatttctgttcgtggccatagccaacgccttcgccaccgtgattgcccttatctttgtgaagacgaatacgaagttccgatcgaacagatccggctttctggtcaaggattacacgcttttctttttcagcgtaccggttttcctgctgataatggtttcatcgcaattctccgttactttgccaatatacatagttgatgacctccatattgtgataaagaacctggcctacttctatgctgtcaacggaatagtggttgtcgtgggccagtatcccatatccagaatgatgagggggcactctgacctttacggcctcatattcggatctgtcttctacaccatcgggtatcttatggtctcgttctcgcacagcctgttctatctcataatcgacatgatcattataaccataggcgagaactttacctcaccgaacataagcactgtggcgtcgaaaatcgcacccagggacaaggttgggcgttatatggggttcataggcatgataaaccagcttgccagaacggcatcgccgtccgtgggcacattcatactatattcgctttcatcttctcccatcctggtctggccagcgatagatggattcggcatatcggccatcatcctgttccttgtattcaagatcgcattcgttgacaggagcagggcttctggcaggcctgtgaatatctaa

SEQ ID NO: 587 - protein, 403 aa, Thermoplasma acidophilum
MIGGNAPAPYYRNRSLWGVSIAASVRSIGYGATWPFLAVYFNTYLHMSLLFVGLIFTLNSGISIVFSLFAGYMAAAFGRKFTLVLGNVAGFILYLLLSIFSGKNVAIISTLFVLTAFSGSLVFPSANSIVSDITSSMDREMGYAIYRIMANLGWAIGPLISAIIFSYGFGFIFLFVAIANAFATVIALIFVKTNTKFRSNRSGFLVKDYTLFFFSVPVFLLIMVSSQFSVTLPIYIVDDLHIVIKNLAYFYAVNGIVVVVGQYPISRMMRGHSDLYGLIFGSVFYTIGYLMVSFSHSLFYLIIDMIIITIGENFTSPNISTVASKIAPRDKVGRYMGFIGMINQLARTASPSVGTFILYSLSSSPILVWPAIDGFGISAIILFLVFKIAFVDRSRASGRPVNI

SEQ ID NO: 588 - DNA, 1212 bp, Thermoplasma volcanium
  CDS (1)..(1212)
atggcggtgttatcttcaaaggaccttatgttcgaaaacaggacgttgtggggagtaagcaccgccgctgctgtcaggagcatcgggtatggggcaacatggccttttatggcagtttacttcaacgaataccttcacttgagcttaatattcgttggttttatatttacccttaacgctgccctatctatagtttttagtctatttgccggctatctgtccgatgtcatagggcggaaatggacactcatctctggaagcgttgccggcttcatactttacgcattgcttgcactcttagtctacagagctgttttgatagcttcggctctctttgtgatgacagctttttcaggttctcttgtctatccgtcagcaaatgcgattgtatccgacgtaactacggaaaagaatagggagatggggtatactgtatacagaataatggccaatctaggatgggcagtaggtccacttataagttcgtttatatttaggtacggcttcgagtttatattcctctttgttgccgtagcaaaccttctctctacaattgtatcgcttttgtatgtgaaaagaaatgtaagatacagagaagctaaaaggaatttctttgtggtagactacaggctttacctcttcagtatacctgtatttcttcttataatggtctcttctcaattttctgttactcttcccatattcgttgtagaggacttgcatattgtggtttctaacctcggctatttctacgcagttaatggtacagttgttgttattgggcagtatccaatatcaaagttaatgtcaagatatcctgacatctatgctcttgtctttggtgcgatattttattcaattggataccttatggtgtcattttcgaggaacctaccatctctaatcattgacatgataataataacaataggcgaaaacttaacttctcctaatataaacacggttgtatctaagatagccccgaaagaaagtgtcggccaattcatgggattcataggtatggtgaaccagctcgctagggccgctgccccatcagttggtacattgatactttactcactgggccaacggccaggacttgtatggccagttatcgacatatttgggatatcagcagcaatcctattctttagcttcagagggttatttgttccgcgcaaacgcataagaggggcggcaatgcaaaactaa

SEQ ID NO: 589 - protein, 403 aa, Thermoplasma volcanium
MAVLSSKDLMFENRTLWGVSTAAAVRSIGYGATWPFMAVYFNEYLHLSLIFVGFIFTLNAALSIVFSLFAGYLSDVIGRKWTLISGSVAGFILYALLALLVYRAVLIASALFVMTAFSGSLVYPSANAIVSDVTTEKNREMGYTVYRIMANLGWAVGPLISSFIFRYGFEFIFLFVAVANLLSTIVSLLYVKRNVRYREAKRNFFVVDYRLYLFSIPVFLLIMVSSQFSVTLPIFVVEDLHIVVSNLGYFYAVNGTVVVIGQYPISKLMSRYPDIYALVFGAIFYSIGYLMVSFSRNLPSLIIDMIIITIGENLTSPNINTVVSKIAPKESVGQFMGFIGMVNQLARAAAPSVGTLILYSLGQRPGLVWPVIDIFGISAAILFFSFRGLFVPRKRIRGAAMQN

SEQ ID NO: 590 - DNA, 1200 bp, Pasteurella multocida
  CDS (1)..(1200)
atgccagtagcaaccaatacgacgtggaatcagaccgcacttatctgcttcttaggcacattggtgggctttggaccgctttccattgatatgtatctgccgtctttaccgaccattgcgaaagctttacataccagtattgaatgggtacaactgtccgttagtacttttctgacggggttttgtgtggggatgttgttttatggtcccttatccgataaatatgggcgccgtattattttgctgattggcatgacgatttatattgtggcaagcattgcgtgcagtattgctactagcattgaacagctgttagtcgcccgttttttacaagcctttggcggtggggtaggtcccgtattagggcgggcgattgtgcgtgatagtttcccgccacagcgtattacgcacgtgctttctatgatgcagttagtcacgatgcttgcccctctcttagcgccttttatcggcggtattgtgttgttatggtttggctgggaaactcagttcttacttttagcgttaattggggtggtttgttggttaattgcttattttttcttagcggaaaccaatcaagaccgccatcaacgtccgttaaatcttggcacattttttcaagcatattgtgggattttgaaacaaccacaatctttcggcaatattctttgtttaagtgccatgtttggcggcatgtttgcttatgtagccggtacgccctttgtttacattgattatttccatattccgcctcaggactacggattttactttggcatcaatgtggttggtattgtgttagcaactttaattaataactattgtgttaaacgttatgccgtccagcgtgtgttaatggcggaaatgggcttagtggcattggctggcatggcgttttttctggcagaccccgattccttatttgccataatgttaccgctttttatttttgtcgggttaacgggggcgctcacgcctaatgtgatgaccagtttattaaaacagcatagccatgcagcaggtgcggcgatggcacttgtggcttcgatgcagtttgccggtggttttgtggcaagtggcgcattgtcttacttttttaacaacagtccgcaaaccatgctttgggtcatgagtacttgcgcaggtgttgccattgtgggctttatgattacgttaaaaccaaattcaatttcatcttaa

SEQ ID NO: 591 - protein, 399 aa, Pasteurella multocida
MPVATNTTWNQTALICFLGTLVGFGPLSIDMYLPSLPTIAKALHTSIEWVQLSVSTFLTGFCVGMLFYGPLSDKYGRRIILLIGMTIYIVASIACSIATSIEQLLVARFLQAFGGGVGPVLGRAIVRDSFPPQRITHVLSMMQLVTMLAPLLAPFIGGIVLLWFGWETQFLLLALIGVVCWLIAYFFLAETNQDRHQRPLNLGTFFQAYCGILKQPQSFGNILCLSAMFGGMFAYVAGTPFVYIDYFHIPPQDYGFYFGINVVGIVLATLINNYCVKRYAVQRVLMAEMGLVALAGMAFFLADPDSLFAIMLPLFIFVGLTGALTPNVMTSLLKQHSHAAGAAMALVASMQFAGGFVASGALSYFFNNSPQTMLWVMSTCAGVAIVGFMITLKPNSISS

SEQ ID NO: 592 - DNA, 1149 bp, Thermoanaerobacter tengcongensis
  CDS (1)..(1149)
atgggatattcagctattatctattattatttcataatcttttacgcagtattttttatgggtggagctatttatggcacttttgtgccggtttatctggactacataggttatagtaagagtgaaattggaattttgatgtctttaggtccttttgtcgctataatagctcagccattttgggggattacaagcgacagagcgaggtctaaaaattttgtcttgcaaattttatttttagccagtattttcattatggcgttgttccctttgtcgcgcaacttttactatctggtagccgttataacacttttcacattttttcagacttctactggccccataagtgatgccataacattggaatatttaagtgggacaggtcaaagttttggaccaattaggatggcaggcacaattggatatgcagtaatgtcagttatagcaggatggtttgcccaaagacatattgggagtatttttattttgaacattatagtgatgttcatagcctttatgattgtctataaacttccggtcgtaaaaggacatcagtttgggaaagagaaaatttccatatggaaacttttttcaaatagaaatttagtggtgttaatgcttcttaattttttaatccagactactttggggttttattatacgtattttcccatctactttagaaagataggagggagcaacgaacttctgggattagcctattttatttctgcaatgagcgaaataccgtttttgttgtatgctgacaagatacttaaacgaataggaacaaggtgggcattaataggagcaagtggagtagcggctttaaggtggcttattatatcgtttattcctaatgcatatttagttttgccttttcagcttttgcacggattgatttttatagtattgtactattccatggcaacttatattaatcaagaagtaccaaaagaactaaaagcgtcggggcagactgtgaacaatctaataggtatgggaatttcgagaattgttggaagtttattgggagggtttttaagcgacctttatggaataaaaatggtatttctttataattctgtattagctttttgtatagcattaatttttgggtacatctttttaaaaaaagcgtcaaaataa

SEQ ID NO: 593 - protein, 382 aa, Thermoanaerobacter tengcongensis
MGYSAIIYYYFIIFYAVFFMGGAIYGTFVPVYLDYIGYSKSEIGILMSLGPFVAIIAQPFWGITSDRARSKNFVLQILFLASIFIMALFPLSRNFYYLVAVITLFTFFQTSTGPISDAITLEYLSGTGQSFGPIRMAGTIGYAVMSVIAGWFAQRHIGSIFILNIIVMFIAFMIVYKLPVVKGHQFGKEKISIWKLFSNRNLVVLMLLNFLIQTTLGFYYTYFPIYFRKIGGSNELLGLAYFISAMSEIPFLLYADKILKRIGTRWALIGASGVAALRWLIISFIPNAYLVLPFQLLHGLIFIVLYYSMATYINQEVPKELKASGQTVNNLIGMGISRIVGSLLGGFLSDLYGIKMVFLYNSVLAFCIALIFGYIFLKKASK

SEQ ID NO: 594 - DNA, 1215 bp, Staphylococcus aureus strain MW2
  CDS (1)..(1215)
atgtttgcagcgttattacaaataaagaattataaactctttgttgctaatatgtttctactaggtatgggtattgcggttacggtcccatatcttgttctttttgcaactaaagatttaggtatgacaacaaatcagtatggattacttctagcatctgcagcgattagccagtttacagtaaattcaattattgctagattttcggatacgcatcactttaatagaaaaattattattattctcgcattattaatgggtgcgcttggtttttcaatatacttttttgtagatacaatctggttattcatattactatatgcgattttccaaggattatttgcaccagcaatgccccaactttacgcatctgctagagaatctatcaatgtttcaagctctaaagatagagctcaatttgccaacacagtattacgttcaatgttctcattgggctttttatttggtccatttattggtgcccaattaatcggtttaaaaggctatgctggattgtttggtggaacaataagtatcattttatttactttagtacttcaagtgtttttctataaggatttaaacattaaacaccctattagtacgcaacaacatgttgaaaaaattgctcctaatatgtttaaagacaaaacgcttttattaccatttattgcatttattttattacacattggacaatggatgtatacgatgaatatgcctttatttgttactgattatttaaaagaaaatgaacaacatgtcggttatttagctagtttatgtgctggtttagaagtgccatttatgatcattcttggcgttttatcatctagattacagactcgaacattgttgatttatggagcgatttttggtggtttattctacttcagcattggggtatttaaaaacttctatatgatgttagcaggacaggtgtttttagctattttcttagcggttcttttaggaattggtattagttatttccaagatatcttaccagattttccaggatacgcctcaacactattttctaatgcaatggttattggacagttaggcggtaacctattaggtggtgctatgagtcactgggtaggtttggaaaatgtattttttgtatcagcagcatcaatcatgttaggtatgatacttatattctttactaaaaatcaaaaaattacaaaagaggatgtgatatcaacataa

SEQ ID NO: 595 - protein, 404 aa, Staphylococcus aureus strain MW2
MFAALLQIKNYKLFVANMFLLGMGIAVTVPYLVLFATKDLGMTTNQYGLLLASAAISQFTVNSIIARFSDTHHFNRKIIIILALLMGALGFSIYFFVDTIWLFILLYAIFQGLFAPAMPQLYASARESINVSSSKDRAQFANTVLRSMFSLGFLFGPFIGAQLIGLKGYAGLFGGTISIILFTLVLQVFFYKDLNIKHPISTQQHVEKIAPNMFKDKTLLLPFIAFILLHIGQWMYTMNMPLFVTDYLKENEQHVGYLASLCAGLEVPFMIILGVLSSRLQTRTLLIYGAIFGGLFYFSIGVFKNFYMMLAGQVFLAIFLAVLLGIGISYFQDILPDFPGYASTLFSNAMVIGQLGGNLLGGAMSHWVGLENVFFVSAASIMLGMILIFFTKNQKITKEDVIST

SEQ ID NO: 596 - DNA, 1212 bp, Chlorobium tepidum
  CDS (1)..(1212)
atggagatgaagcaggagaagcgctttttcgggttgagcggcaacgtcttttttgccgggctggtgagcttctgcatggacgtcagttccgagatgatctacccgctggtgccgctgtttctggccagcgtgcttggggtgaacaaggccatgatcggcctcatcgaggggagcgccgagtcgatggcgagcctggtcaaggtcttttccggctggtactccgaccggctcggcaagcgcaagcggctgatgctggcgggctattcggtctcgacgttgagccgtccgctgatggcgctggctggcggctggcatcaggtgctggccgcgcgtctcgttgaccgcttcggcaagggcgtccgcaccgcgccgcgtgacgccattattgcggattccaccgaaccgtcatggcttggccgcgctttcagctttcaccgctcgatggacactatgggcgcggttgtcggcccggccatcgcctttatcggcttgcaagtgtaccacagctcttaccgtcagcttttctggctctcgagcctgccgggcgttctcgccgtgctcatcatcgtcttcttcatccgggaaaagcgggacgcgccggtcagggctgacgctgaaaagccgcggagtaccggaggcgggaagctcgaccggcgggcgtggtttttcatcgtgatcgtcgcggtcttcgcgctgggcaattcgagcgatgcgtttctgatcctccgtgccggccagctcggcgttccggcggcgatgattcccgccgtttatctgctcttcaatctcgtctattccatcacggccattcccgccggaatcgtcgccgaccggtatggccgcaagcggctcattctcgcaggattcgtgctgttcgccgccctgtacgcagggttcgccgtggcgggaagtccgcttgccgtgtgggttttgttcgcactttacggagtcttcatggggctgaccgaggggatccagaaggcgtttctcgctacgctgacgccggaaggtctcaaaggcacggcattcggcctctatgccggagccgtcggattggcggcattgccgtcgagcctgatcgccggagtgttgtgggacagggtttcgccatcagcgacattctggttcggcgcggcgacagccttgctcgcagccgcgctgttcgcggtgtttatcgcggggataaagtcgaagccctctttcggggagtaa

SEQ ID NO: 597 - protein, 403 aa, Chlorobium tepidum
MEMKQEKRFFGLSGNVFFAGLVSFCMDVSSEMIYPLVPLFLASVLGVNKAMIGLIEGSAESMASLVKVFSGWYSDRLGKRKRLMLAGYSVSTLSRPLMALAGGWHQVLAARLVDRFGKGVRTAPRDAIIADSTEPSWLGRAFSFHRSMDTMGAVVGPAIAFIGLQVYHSSYRQLFWLSSLPGVLAVLIIVFFIREKRDAPVRADAEKPRSTGGGKLDRRAWFFIVIVAVFALGNSSDAFLILRAGQLGVPAAMIPAVYLLFNLVYSITAIPAGIVADRYGRKRLILAGFVLFAALYAGFAVAGSPLAVWVLFALYGVFMGLTEGIQKAFLATLTPEGLKGTAFGLYAGAVGLAALPSSLIAGVLWDRVSPSATFWFGAATALLAAALFAVFIAGIKSKPSFGE

SEQ ID NO: 598 - DNA, 1188 bp, Escherichia coli O6
  CDS (1)..(1188)
atgaacttatccctacgacgctctaccagcgcccttcttgcctcgtcgttgttattaaccatcggacgcggcgctacgctgccgtttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttaatggcaattaccgccttcgctagcggttttattgccattcctttagtgaataacgtgacgctggtggtgctcttttttgcccttattaactgcgcctactccgtttttgctaccgtgctgaaagcctggtttgccgacaatctttcgtccaccagcaaaacgaagattttctcaatcaactacaccatgctcaacattggctggaccatcggtccgccactcggcacgctgttggtgatgcagagcatcaatctgcccttctggctggcagctatctgttccgcgttccccatgcttttcattcaaatttgggtaaagcgcagcgagaaaatcatcgccacggaaacaggcagtgtctggtcgccgaaagttttattacaagataaagcactgttgtggtttacctgctctggctttctggcttcttttgttagcggcgcatttgcttcatgcatttcacaatatgtgatggtgattgctgatggtgattttgccgaaaaggtggtcgcggttgttcttccggtgaatgctgccatggtggttacgttgcaatattccgtgggccgccgccttaacccggctaacatccgcgcgctgatgacagcaggcaccctctgtttcgtcatcgggctggtcggttttattttttccggcaacagcctgctattgtggggtatgtcagctgcggtatttactgtcggtgaaatcatttatgcgccgggcgagtatatgttgattgaccatattgcgccgccaggaatgaaagccagctatttttccgcccagtctttaggctggcttggtgctgcgattaacccattagtgagtggcatagtacttaccagtctgccgcctttctcgctgtttatcatcttagcgttggtgatcgttgttgcgtgggtgctgatgttaaaaggaattcgtgcaagaccgtgggggcagcccgcgctttgttaa

SEQ ID NO: 599 - protein, 395 aa, Escherichia coli O6
MNLSLRRSTSALLASSLLLTIGRGATLPFMTIYLSRQYSLSVDLIGYAMTIALTIGVVFSLGFGILADKFDKKRYMLMAITAFASGFIAIPLVNNVTLVVLFFALINCAYSVFATVLKAWFADNLSSTSKTKIFSINYTMLNIGWTIGPPLGTLLVMQSINLPFWLAAICSAFPMLFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLVGFIFSGNSLLLWGMSAAVFTVGEIIYAPGEYMLIDHIAPPGMKASYFSAQSLGWLGAAINPLVSGIVLTSLPPFSLFIILALVIVVAWVLMLKGIRARPWGQPALC

SEQ ID NO: 600 - DNA, 1182 bp, Escherichia coli O6
  CDS (1)..(1182)
atgcataactcccccgcagtcaccagcgcgaaatcgtttgacctgacctcgacggcgtttttaatcgttgcctttctcaccggtattgcgggcgctctgcaaaccccgacactcagtatttttcttactgatgaagtacatgcccgtccggcgatggtgggattcttctttaccggcagcgctgtcattgggattctggtgagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcaaccgctaacccgcaaatgtttgcccttgcccgtgaacatgctgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggcgtgatggtgtggctgtttttgccgtcgatgcaaaaagagcttccgctggcgaccggcacggttgaagcgccgcgccgtaaccgtcgcgatacgttgctgctgtttgtcatttgtacattgatgtggggctcgaacagcctgtacatcatcaacatgccgctatttattatcaacgaactgcatcttcccgagaaactggccggtgtgatgatggggaccgccgcagggctggaaatcccgaccatgttgatcgccggatattttgccaaacgtctgggtaagcgcttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgctactctgttttgcttactgcgaattaaagatgtttaa

SEQ ID NO: 601 - protein, 393 aa, Escherichia coli O6
MHNSPAVTSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 602 - DNA, 1200 bp, Vibrio vulnificus
  CDS (1)..(1200)
atgttgcaagatcgtaccgccattttatttgtgattaccgccaccattatcggcttgtgtggcgcgtttttttatccactcaccagcttgtttttggttgaacggttgaatgccacaccgatgatgctgagtctttatatggtggttgcggtaataagctctgtgtcggtttcgcaagtgatcgcaggcaaatcagacagaggttggcaacgtaagacgatcttgctgatttcggtcagttgtcagcttgtgaccgtatttagctttatttttatccgtgagtactggattgcgattgtcgtggtttctttattgggcagcatcagtggtgcggcatttgggcaactttttgctctgggaagagagtatggcgacaagtatgtgactgacagcgcgagctttgtttccactatgcgagcgggaatagcgatcgcttgggtatttggtcctccgttggcttttctgctcaaagcggcttatggctttgaagcgtcatttactgtcgcagccaccattattgctatgtcaattttagtgatatttcttggtatccctaatgtcgaacgtaacctccgtgtagaaaaagagcctagtagggcgaatgggggctgggtatcttcagtgaatccgttggtgtctatttattgcctcattatcgtgctcgcgtttgctgcaaacaatctctacatcgtttcgatgccgttgtacttgtctcaagaattgaaagtcgatgcaaactggcttggcgtgttgtttggagtggctgcgctgtgcgagattccagtgatgttgtgggctgggaagttggccaggagatggagtgcattgaccataatgaaagtcggtattgcttcaggagtgcttttctacagcgtgatgttattggcgaccaactacacgcacctcattgttgctcaaatactgaatggcatttttatcgggacctgtgcaacgctggggatggttgtcatgcaggatatgatgaaagacaagttaggtactgcttcaactttgttttccaacatgttgcagctaagtatgctggtgtcgagtttgtcggtcggcgtggttggtgaactatttaattactacagcagtttttacgtgagtttgtttggtgtctctttagcactgattttactgatctgctgccaaactagactctctgcttcggctaagcttgtgcccaactcaaattaa

SEQ ID NO: 603 - protein, 399 aa, Vibrio vulnificus
MLQDRTAILFVITATIIGLCGAFFYPLTSLFLVERLNATPMMLSLYMVVAVISSVSVSQVIAGKSDRGWQRKTILLISVSCQLVTVFSFIFIREYWIAIVVVSLLGSISGAAFGQLFALGREYGDKYVTDSASFVSTMRAGIAIAWVFGPPLAFLLKAAYGFEASFTVAATIIAMSILVIFLGIPNVERNLRVEKEPSRANGGWVSSVNPLVSIYCLIIVLAFAANNLYIVSMPLYLSQELKVDANWLGVLFGVAALCEIPVMLWAGKLARRWSALTIMKVGIASGVLFYSVMLLATNYTHLIVAQILNGIFIGTCATLGMVVMQDMMKDKLGTASTLFSNMLQLSMLVSSLSVGVVGELFNYYSSFYVSLFGVSLALILLICCQTRLSASAKLVPNSN

SEQ ID NO: 604 - DNA, 1182 bp, Yersinia pestis
  CDS (1)..(1182)
atgagatctgcacgagccttttcccgtcgtatcaacccggttttcctcgctttctttgtggtggcttttctttccggcatcgcgggtgcgttgcaagccccgacattaagcctgtttttaagcacagagttaaaagtgcgtccgctgtgggtcggattgttttataccgtgaatgccattgccggtatcaccgtgagcttcctactggccaaacgctcagatctgggcggggatcggcgtaaattaattctgatctgctatctgatggcggtcggaaattgcctgctattcgcttttaatcgtgattatctgacgttgatcactttaggtgttttgatggcctcggtggcgaataccgcgatgccgcaaattttcgccttggcacgggaatatgcggataactctgcgcgtgaagtggtgatgttcagttcgattatgcgtgcgcaattatcattggcttgggttatcgggccaccgctgtcatttatgttagcgctgaattatggctttacgctgatgtttagcattgccgccggtatttttgttattagtgcgctggtggtctggtttatcctgccgtcggttaaacagcctgagcccgtagccgatgcccccgtggtggtacaaggcagtttgtttgccgataaaaatgtcttactgctgttcattgcctcaatgctgatgtggacgtgtaataccatgtacatcattgatatgccgctctatatcaccgctaatttagggttgcctgagcgtttggcgggtttgctgatggggaccgccgccgggctggaaattcctatcatgttgttggcaggttactcggttaggcgctttggtaaacgtaaaatcatgctgtttgcggtgatggcgggggtgctgttttataccgggctggtgctgtttaaattcaaaaccgcactgatgatattgcagatttttaatgccatctttatcggcatcgtcgccggtattggtatgctctattttcaggatctcatgccggggcgggcaggtgccgcaaccacgttatttaccaacagtatttctagtggggtgattttggccggtgtgctgcaaggtgtattgactgaaacctgggggcataatgcggtttatgtcgctgcgatggtgttggttattttggcgttgatcatctgcgccaaagtgagagaggcttaa

SEQ ID NO: 605 - protein, 393 aa, Yersinia pestis; identical to SEQ ID NO: 585

SEQ ID NO: 606 - DNA, 1209 bp, Staphylococcus epidermidis
  CDS (1)..(1209)
atgtttacagcattattgcaaataaagaattataaattgtttgtggtcaatatgttgttactaggtatgggaatagcagtgactgtaccttatttaattttatttgctacaaaagatttggggatgacgacaacacaatatggactgctacttgcacttgctgcgataagtcagtttatagtcaattccattattgcaagattttctgatacacatcatcttaatagaaagattctaatcatcactgctttgtttatgggggcagtgagcttctcaatttatttctacgttcatcaaatatggttattcatcgtgttatatgcgttgtttcaaggattatttgcaccagcaatgccacaattgtatgcctctgccagagaatcaatcaatgcttcaagttcacgtgatcgtgctaagtttgctaatactgttttacgttcaatgttttcacttggttttttatttgggccatttataggtgcacaacttattgagttaaaaggttattctggattatttggtggcacaatagctattattttatttactttaattttacaagtgtttttttataaaaatttaccggtaaaaaatcaaatttctgaacaacagcatattgagaaaatcgcaccaaatatgtttaaagataaatcattatttattccatttatagcgtttatattacttcatattgggcaatggatgtatacgatgaatatgccactttttgtgacagattatttaaatgaaaaggaaagatatgtaggctatttagcaagtttatgtgcaggtttagaagtgccgtttatggttatattaggtatattatcagctaaattgccaactcgaactttattgataattggttctgtatttggtggcgcattttactttagtattggtgtatttaaaaattttcatatgatgcttgttggacaaatatgtttagccatctttctagcaatattactaggtcttgggattagttattttcaagatattcttcctgattttccaggttatgcatcaacactttttgccaatgccatggtaataggacaacttggtggtaatttgctaggtggtgtgatgagtcattgggttggtttggaaaatgtattctttgtctcagcaagttctatcttcgtagggatgatactcatcttgtttacgaaagatcaaaaaattacaatagaagatgtggagtaa

SEQ ID NO: 607 - protein, 402 aa, Staphylococcus epidermidis
MFTALLQIKNYKLFVVNMLLLGMGIAVTVPYLILFATKDLGMTTTQYGLLLALAAISQFIVNSIIARFSDTHHLNRKILIITALFMGAVSFSIYFYVHQIWLFIVLYALFQGLFAPAMPQLYASARESINASSSRDRAKFANTVLRSMFSLGFLFGPFIGAQLIELKGYSGLFGGTIAIILFTLILQVFFYKNLPVKNQISEQQHIEKIAPNMFKDKSLFIPFIAFILLHIGQWMYTMNMPLFVTDYLNEKERYVGYLASLCAGLEVPFMVILGILSAKLPTRTLLIIGSVFGGAFYFSIGVFKNFHMMLVGQICLAIFLAILLGLGISYFQDILPDFPGYASTLFANAMVIGQLGGNLLGGVMSHWVGLENVFFVSASSIFVGMILILFTKDQKITIEDVE

SEQ ID NO: 608 - DNA, 1197 bp, Lactobacillus plantarum
  CDS (1)..(1197)
atggatcgacaaacacgacgcgcaattttaattttagtttttagtgagtttttagtttgtttagggattagtttagttattccagtcatgccgtttattaaaaatgaactgcatttaacggctaccgatatgggaataatgaatgcgctattcgcattggcacaatttgtggcctcacccattattggccgggtttcagacaaagttggtcgcaagcccgtattaacggtagggctagtcttatatatggtctcggaagtactatttgcgctaaccaaccagctgtgggtctttaatatttcccggattgttggtggcttatcagcagcgatggtcgttccgacggcgatggcgttagcatccgatattacgaccaaacgacagcgagctaaagtaattggctggttatcggcggcctttagtggtggcttgattttaggacccggtatcggtggggtattggctggcattagttataagacgccgttctgggttgctggtgcattgggattactcagtgccattgtgctcgtcattctgttgcctgcggatcgtcagattgatcctgatcgcgaagcaattacggccacgacaacgacgaccaatcatccgatgacgcgggcattttggaccgtcccgattattatattatttacgatgattttagtgtcttcctttggcttacaggggtttgagagcatttatagtatttacgtgaatgaagtctttcattttagtctgagcaacattgcgttggtcttgactttaaatggtttgatttcgctcttcctacaggtggcactatttgatacctttgtccagcgttggggcgaacggcgggtcattcgggtgtgctttgcagctgcggcgctctgcactatctggattacgcaggctcattcgaaagttgctgtcatggttgcaacgctcgttattttttcggcattcgatcttttgcggcccgctattacgaccctattaacgaaagcaagtgaggccaaccaggggctaatcaatgggcttaacatgtccttaacgagtgttggcaatatcgttggcccaatcatgtcggggatgttactagatatgaattatcactatccatatctagtggtggccggattcttgattgtctcttatttaatggcgtttatgttacgattaccgaaccaggttcattcacatcagcaagtttaa

SEQ ID NO: 609 - protein, 398 aa, Lactobacillus plantarum
MDRQTRRAILILVFSEFLVCLGISLVIPVMPFIKNELHLTATDMGIMNALFALAQFVASPIIGRVSDKVGRKPVLTVGLVLYMVSEVLFALTNQLWVFNISRIVGGLSAAMVVPTAMALASDITTKRQRAKVIGWLSAAFSGGLILGPGIGGVLAGISYKTPFWVAGALGLLSAIVLVILLPADRQIDPDREAITATTTTTNHPMTRAFWTVPIIILFTMILVSSFGLQGFESIYSIYVNEVFHFSLSNIALVLTLNGLISLFLQVALFDTFVQRWGERRVIRVCFAAAALCTIWITQAHSKVAVMVATLVIFSAFDLLRPAITTLLTKASEANQGLINGLNMSLTSVGNIVGPIMSGMLLDMNYHYPYLVVAGFLIVSYLMAFMLRLPNQVHSHQQV

SEQ ID NO: 610 - DNA, 1254 bp, Pseudomonas syringae pv tomato
  CDS (1)..(1254)
atggccagtcatgcagatcgccgcaacgccctttcactggacagccttaattttttcctcgccgatgtgcgcgatggtttgggtccttacctggcgatctacctgctggcggtccatcaatgggacccggccagtatcggcgtggtcatgaccatcgcgggtatcgccgggctgctgacccagacgcccgcaggtgctctgatcgaccgcacaccctacaagcgcgggatcatcggtgtggcggcgctgctggtgacgttgagctgtctgattctgcctttcacctcttcatttaccctggttgccatcacccaggcgctgagcagcgtcgccgcttcggtgttcgcaccagccattgctgcgatttcgctgggcattaccggaccgaaagcgttcacccgacgcaccgggcgcaatgaaaccttcaatcatgcgggcaacgcctgtgcggccctgctggcaggcggcttcgcttacctgttcggcccgattgcggtgttctatctgatggccgcaatggccttggcgagcgttgtcgcgatcagttttgtgtctgccgatgccattgatcatgacgtggccagaggctttgatgcatcgcatacctcacatggcagtcagccttccggtctgtccgcattactgaacaacagaaccctgctgctgttcgggatttgctgcgcactctttcatctggccaacgcagcgatgctgccactggtgagtcagaagctttcgcaaatcaacatgcagatggcgactccgctgacctcggcctgcatcgtcgcggcgcaactggtgatggtgccggcggcgctgctggtgggtatgaaggccgatgtctggggacgcaaaccgctgctgctggccggtttcctgattcttccgatccgcggcgtgctgtatacgctgtccgatgatccgtactggctggtggccgtgcagatgctcgacggcatcggcgcgggcctgtttggcgcactgttcccgttgatggtcaaagacctgactcagggcagcggccgtttcaatgtgagccttggggcgctgtcgaccctgtttggcctgggcgcggcgctgagcaacagcctggccggtttcgtggtgcatgcggccgggtacagcgcagcatttctgacccttgcggcggtggcggcagtggcgttctgtttgctgctggtggcggtgccggagacgctttcgcggtcggatcatgcgcctgagctcaagccggatcatgccgtgaatacgtga

SEQ ID NO: 611 - protein, 417 aa, Pseudomonas syringae pv tomato
MASHADRRNALSLDSLNFFLADVRDGLGPYLAIYLLAVHQWDPASIGVVMTIAGIAGLLTQTPAGALIDRTPYKRGIIGVAALLVTLSCLILPFTSSFTLVAITQALSSVAASVFAPAIAAISLGITGPKAFTRRTGRNETFNHAGNACAALLAGGFAYLFGPIAVFYLMAAMALASVVAISFVSADAIDHDVARGFDASHTSHGSQPSGLSALLNNRTLLLFGICCALFHLANAAMLPLVSQKLSQINMQMATPLTSACIVAAQLVMVPAALLVGMKADVWGRKPLLLAGFLILPIRGVLYTLSDDPYWLVAVQMLDGIGAGLFGALFPLMVKDLTQGSGRFNVSLGALSTLFGLGAALSNSLAGFVVHAAGYSAAFLTLAAVAAVAFCLLLVAVPETLSRSDHAPELKPDHAVNT

SEQ ID NO: 612 - DNA, 1242 bp, Pseudomonas syringae pv tomato
  CDS (1)..(1242)
atggctcacaacaataataaagccagttatgaaaatgtcctgctctgcgtgttgttcctgacgttcggttttgtgtttttcgaccgtctggcgctgtcctttctgtttccgttcatggcgcgagagctgcaactgagcaacagccaccttggcatgttgtcttcggtgctggcattggcctgggcgatttccgggacgctagtaggcgcgtggtcggatcgccgaggggtacgcaagccgctgctgattgccgcggtcatcctgttttcgctgtgctcagccctctcggggctggtcgcggggttcctcagcctgttgctgtttcgcgccatcatggggttggccgaggggcccatcctgccgttgtcccaatcgatgatggtggaggcgtcatcgccgcatcgccggggcttgaacatgggcttgcttcaaggctcggcggcgggtctgttgggcgcggtcatcggccctccggtgttgattgccctggcgcaggcctatggctggcggcatgcgttcattgtctcgctgctaccaggactgctcatcgcctggcttatctggcgttacgtgcgccacgatgaacctcgtcaggctccggtgagtaacgtcaagctcaccgggcatcgcctggcactgcttaaaagtcgcaatatcgtgctgtgcacattgatcagttgcgtatttctgacctggttcgtgatcctgatctcctttaccccgacgtttctggtcagcgtccgcggttacagcgcgccgagcatgggcacgatcatgagttgcctgggtgccgcctgggttgtatgggggtttgcggtgcccagcatttccgaccgcatcggccgccgtccgacgctggtgctgttctcgctgattgcggcctgctgcccgatagccctgctattcgcgccttcgccgatgatactcggcgtgctgatggtgctcaccttcaccgggcttggctgcttcacgctgttcatgtccaccattccagccgaaaccgtcccgcgtgaagtcatggccacggctctgggcatgatcatgggcattggcgaactggtgggaggcttcgtggcgccgaccattgccggggttgccgccgatcagttcgggttgtcgattgtgatgtggatctcctgctgcggcgccgtgctggctgcggggctgtcgctgttgctaaaggaaaccgcgcccaccgtgctgcaacgccgatcagtgcaagcctgcacacagcgtgcgtaa

SEQ ID NO: 613 - protein, 413 aa, Pseudomonas syringae pv tomato
MAHNNNKASYENVLLCVLFLTFGFVFFDRLALSFLFPFMARELQLSNSHLGMLSSVLALAWAISGTLVGAWSDRRGVRKPLLIAAVILFSLCSALSGLVAGFLSLLLFRAIMGLAEGPILPLSQSMMVEASSPHRRGLNMGLLQGSAAGLLGAVIGPPVLIALAQAYGWRHAFIVSLLPGLLIAWLIWRYVRHDEPRQAPVSNVKLTGHRLALLKSRNIVLCTLISCVFLTWFVILISFTPTFLVSVRGYSAPSMGTIMSCLGAAWVVWGFAVPSISDRIGRRPTLVLFSLIAACCPIALLFAPSPMILGVLMVLTFTGLGCFTLFMSTIPAETVPREVMATALGMIMGIGELVGGFVAPTIAGVAADQFGLSIVMWISCCGAVLAAGLSLLLKETAPTVLQRRSVQACTQRA

SEQ ID NO: 614 - DNA, 1179 bp, Shigella flexneri
  CDS (1)..(1179)
atgcataactcccccgcagtctccagcgcgaaatcgtttgacctgacctcgacggcgtttttaatcgttgcctttctcaccggtattgcgggtgctctgcaaaccccgacactcagtattttccttaccgatgaagtacatgcccgtccggcgatggtgggattcttctttaccggcagcgctgtcattgggattctggtaagtcagtttctcgctgggcgctctgataagcgcggcgatcgcaaatcgctgattgtcttttgctgcctgttaggcgtgctggcctgcaccctttttgcttggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgcgttagcgatgggtttcagctttacggtaatgtatctgagcgcagcggtagcgtttattgtttgcggcgtgatggtgtggctgtttttaccgtcgatgcaaaaagagcttccgctggcgaccggcacggttgaagcgccgcgccgtaaccgtcgcgatacgctactgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgccattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgccactctgttttgggtaatgactccaacttactaa

SEQ ID NO: 615 - protein, 392 aa, Shigella flexneri
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPAILLGLQLLNAIFIGILGGIGMLYFQDLMPGQAGSATTLYTNTSRVGWIIAGSVAGIVAEIWNYHAVFWFAMVMIIATLFWVMTPTY

SEQ ID NO: 616 - DNA, 1179 bp, Shigella flexneri
  CDS (1)..(1179)
atgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggactcttttatacggtgaatgctattgctgggatcggcgtaagcctctggttggcaaaacgttctgacagtcagggcgatcggcgaaaactgattatattttgctgtttgatggctattggcaatgcgctactgtttgcatttaatcgtcattatctgacgcttatcacctgtggtgtgcttctggcatctctggccaatacggcaatgccacagttatttgctctggcgcgggaatacgcggataactcggcgcgagaagtggtgatgtttagctcggtgatgcgtgcgcagctttctctggcatgggtaatcggtccaccgctggcctttatgctggcgttgaattacggctttacagtgatgttttcgattgccgccgggatattcacactcagtctggtattgattgcatttatgcttctgtctgtggcgcgggtagaactgccgtcggaaaatgctttatcaatgcaaggtgactggcaggatagtaacgtacggatgttatttgtcgcctcgacgttaatgtggacctgcaacactatgtacattattgatatgccattgtggatcagtagcgatttaggattgccagacaaactggcgggtttcctgatggggacggcagctggactggaaataccagcaatgattctggctggctactatgtcaaacgttatggtaagcggcgaatgatggtcattgcagtggtggcaggagtgctgttttacactggattgattttctttcatagccgtatggcgttgatgacgctgcaactttttaacgctgtatttatcggcattgttgcgggtattgggatgctatggtttcaggatttaatgcctggaagagcgggggcagctaccaccttatttaccaacactatctctaccggggtaattctggctggtgttattcagggagcaattgcacaaagttgggggcactttgctgtctactgggtaattgcgattatttctgttgtcgcattatttttaaccgcaaaggttaaagacgtttaa

SEQ ID NO: 617 - protein, 392 aa, Shigella flexneri
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLLSVARVELPSENALSMQGDWQDSNVRMLFVASTLMWTCNTMYIIDMPLWISSDLGLPDKLAGFLMGTAAGLEIPAMILAGYYVKRYGKRRMMVIAVVAGVLFYTGLIFFHSRMALMTLQLFNAVFIGIVAGIGMLWFQDLMPGRAGAATTLFTNTISTGVILAGVIQGAIAQSWGHFAVYWVIAIISVVALFLTAKVKDV

SEQ ID NO: 618 - DNA, 1119 bp, Shigella flexneri
  CDS (1)..(1119)
atggctacgctgccatttatgaccatttacttgagtcgccagtacagcctgagtgtcgatctaatcggttatgcgatgacaattgcgctcactattggcgtcgtttttagcctcggttttggtatcctggcggataagttcgacaagaaacgctatatgttactggcaattaccgccttcgccagcggttttattgccattcctttagtgaataacgtgacgctggttgtgctcttttttgccctcattaactgcgcctattctgtttttgctaccgtgctgaaagcctggtttgccgacaatctttcgtccaccagcaaaacgaaaatcttctcaatcaactacaccatgctaaacattggctggaccatcggtccgccgctcggcacgctgttggtgatgcagagcatcaatctgcccttttggctggcagctatctgttccgcgtttcccatgcttttcattcaaatatgggtaaagcgcagcgagaaaatcatcgccacggaaacaggcagtgtctggtcgccgaaagttttattacaagataaagcactgttgtggtttacctgctctggttttctggcttcttttgtaagcggcgcatttgcttcatgcatttcacaatatgtgatggtgattgctgatggggattttgccgaaaaggtggtcgcggttgttcttccggtgaatgctgccatggtggttacgttgcaatattccgtgggccgccgacttaacccagctaacatccgcgcgctgatgacagcaggcaccctctgtttcgtcatcggactggtcggttttattttttccggcaacaacctgctattgtggggtatgtcagctgcggtatttactgtcggtgaaatcatttatgcgccgggcgagtatatgttgattgaccatattgcgccgccaggaatgaaagccagctatttttccgcccagtctttaggctggcttggtgccgcgattaacccattagtgagtggcgtagtgctaaccagcctgccgccttcctcgctgtttgtcatcttagcgttggtgatcattgctgcgtgggtgctgatgttaaaagggattcgtgcaagaccgtgggggcagcccgcgctttgttaa

SEQ ID NO: 619 - protein, 372 aa, Shigella flexneri
MATLPFMTIYLSRQYSLSVDLIGYAMTIALTIGVVFSLGFGILADKFDKKRYMLLAITAFASGFIAIPLVNNVTLVVLFFALINCAYSVFATVLKAWFADNLSSTSKTKIFSINYTMLNIGWTIGPPLGTLLVMQSINLPFWLAAICSAFPMLFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLVGFIFSGNNLLLWGMSAAVFTVGEIIYAPGEYMLIDHIAPPGMKASYFSAQSLGWLGAAINPLVSGVVLTSLPPSSLFVILALVIIAAWVLMLKGIRARPWGQPALC

SEQ ID NO: 620 - DNA, 1233 bp, Photorhabdus luminescens subsp laumondii
  CDS (1)..(1233)
atgaaaaatttttctcttagtaattatacatccataccggcatgtatatggggtctatttcttgggacttttgtaacaagatcaacatcaatgatggtatggccttttatatccatcatactatatacaaagtttcattttactgcatcgatgattggattagttctctctttatccattgcgatttcatcaatattaagtttttatgcgggttacttctctgataaagtcggccgggctaagataatcatcattggatgtcttatctcttcattggcatatttaatattatggttatctgaacatcaatctggttttattattggtactttattagcgaatatttcctgggcgctggtgaataacccaataaaagccgttatcggtgatattatcgaggaaaagcaggtaagagagaatgccatgtacttaaggtatttatttcttaatgcgggtgcggtagtcgggccttatttaggcgtaaaattaagcctggatattaattctatttcttttctgattgtttcactatcttatgtaatttttatgatccctgtttatttatttggtaagaaaataaaaataaaattaacaaataatgatgattttaaaggaacgatgaaggttttattaaatgaccgggtgtttttaatgttggtcataaataatattctcatgatgtttatttttggccattttgattcaactttgccacagttaattacttcattagggtttaatgggtatgctgagtttattgcttcgcttattatgttacatgcggtaaccattgtcgttatgcagttaccgttttccatattaacgcaaaaaatggcgttagaaacgaaaataaacgtagggtctgtattactcattttatctgaatttatgttctttatttcattcaaatattatgatgtttatttattgtggtatgtggctgcttttatcatgagtatcagtcaaactattttgtttccatgtgtgaatgtttttattgatcgtttggcaccaaatgatttacgtggcgcatattttggtgcagcgtcactctatagtatcggtttttctatatctccattggttggtggtactgttatccaattatttaatggtggagtgttatttcaattattagcgatattaagtgtattgatgttggtaattttctgtcggatgtttaaactaagggataaacatgaaattaatattagaagaagtctcaaatcttaa

SEQ ID NO: 621 - protein, 410 aa, Photorhabdus luminescens subsp laumondii
MKNFSLSNYTSIPACIWGLFLGTFVTRSTSMMVWPFISIILYTKFHFTASMIGLVLSLSIAISSILSFYAGYFSDKVGRAKIIIIGCLISSLAYLILWLSEHQSGFIIGTLLANISWALVNNPIKAVIGDIIEEKQVRENAMYLRYLFLNAGAVVGPYLGVKLSLDINSISFLIVSLSYVIFMIPVYLFGKKIKIKLTNNDDFKGTMKVLLNDRVFLMLVINNILMMFIFGHFDSTLPQLITSLGFNGYAEFIASLIMLHAVTIVVMQLPFSILTQKMALETKINVGSVLLILSEFMFFISFKYYDVYLLWYVAAFIMSISQTILFPCVNVFIDRLAPNDLRGAYFGAASLYSIGFSISPLVGGTVIQLFNGGVLFQLLAILSVLMLVIFCRMFKLRDKHEINIRRSLKS

SEQ ID NO: 622 - DNA, 1206 bp, Vibrio vulnificus strain YJ016
  CDS (1)..(1206)
atgagtatgttgcaagatcgtaccgccattttatttgtgattaccgccaccattatcggcttgtgtggcgcgttcttttatccactcaccagcttgtttttggttgaacagttgaatgcctcaccgatgatgctgagtctttatatggtggttgcggtaataagctctgtgtcggtttcgcaagtgatcgcaggcaaatcagacagaggctggcaacgcaagacgatcttgctgatttcggtcagttgtcagcttgtgaccgtatttagctttatttttatccgtgagtactggattgcgattgtcgtggtttctttattgggcagcatcagtggtgcggcatttgggcaactttttgctctgggaagagagtatggtgacaagtatgtgaccgacagcgcgagctttgtttccactatgcgagcgggaatagcgatcgcttgggtatttggtcctccgttggcttttctgctcaaagcggcttatggctttgaagcgtcatttactgtcgcagccaccattattgctatgtcaattttagtgatatttcttggtatccctaatgtcgaacgtaacctccgtgtagaaaaagagcctagtaggacgaatgggggctgggtatcttcagtgaatccgttggtgtctatttattgcctcattatcgtgctcgcgtttgccgcaaacaatctctacatcgtttcgatgccgttgtacttgtctcaagaattgaaagtcgatgcaaactggcttggcgtgttgtttggagtggctgcgctgtgcgagattccagtgatgttgtgggctgggaagttggccaggagatggagtgcattgaccataatgaaagtcggcattgcttcaggagtgctgttctacagcgtgatgttattggcgaccaactacacgcacctcattgttgctcaaatactgaatggcatttttatcgggacctgtgcaactctggggatggttgtcatgcaggatatgatgaaagacaaattgggcaccgcttcaactctgttttccaatatgttacagcttagcatgctggtttcgagcttgtcggttggcgttgttggcgagctatttaactactacagcagtttttacgtaagcttatttggcgtttctttagcactgattttactgatctgctgccaaactaagctcgccgcttctacagcgcttgtgccaaactcaaattag

SEQ ID NO: 623 - protein, 401 aa, Vibrio vulnificus strain YJ016
MSMLQDRTAILFVITATIIGLCGAFFYPLTSLFLVEQLNASPMMLSLYMVVAVISSVSVSQVIAGKSDRGWQRKTILLISVSCQLVTVFSFIFIREYWIAIVVVSLLGSISGAAFGQLFALGREYGDKYVTDSASFVSTMRAGIAIAWVFGPPLAFLLKAAYGFEASFTVAATIIAMSILVIFLGIPNVERNLRVEKEPSRTNGGWVSSVNPLVSIYCLIIVLAFAANNLYIVSMPLYLSQELKVDANWLGVLFGVAALCEIPVMLWAGKLARRWSALTIMKVGIASGVLFYSVMLLATNYTHLIVAQILNGIFIGTCATLGMVVMQDMMKDKLGTASTLFSNMLQLSMLVSSLSVGVVGELFNYYSSFYVSLFGVSLALILLICCQTKLAASTALVPNSN

SEQ ID NO: 624 - DNA, 1314 bp, Wolinella succinogenes
  CDS (1)..(1314)Wolinella succinogenes
atgattaagcaggtgctccccctaagcggaatcctggcccttcgattttttggactttttattgtcatgcctgtgctctctctctatgcgttagagatggagggggcgacgccgattttgatgggaatcgccatcggaggttacgcgctcacgcaggtgctcctgcagattccttttggattggtgagtgaccgtatcggacggaagaagacgatcttttttggtctattggtctttgttcttggctcggtggtctgtgcaatggcggagagtatcgagatgctcattgtggggcgattcctccaaggagcaggggcgattgggggcgtggtgagcgccatgattgcggatttggtcaaggaggagcggcgcaccaaggccatggctgtgatgggggcgactatctccatgagcttcaccgccgcgatgattttagggccgatcattggcagctcctttggcgtggataagctcttttggctcaccgccctcttggcaagtttggcgattttggtgctctttatcaatgtccctgaggcgcccttggtgagctactcctttgaggcagaggagagccgctggcaagaggtgttgcacgataagaatcttcaactgatgaatctcaccaacttcctccaaaaagccttcatgacgcttgcttttttgatcatccctttggctttggtcaaggggatgcattttgagcaccaagatttatggaaggtctatattcccgccgccattcttggggtactctccatggcacccgcggcgattttggccgagaaaaagggctactttaaaggggtgttactttttggaatcgtgatgtttgcgctctcttacacctgtatggtgagccgcgagccttggctctttatccttggcgtgatgctcttttttatcggtttttcggcgcacgagcccattatgcagagcttggctagcaaatacgccaaagctcatcaaaaaggggcggcccttggggtttttacctcttttggttatctcggctctttttttggcgggcttttgggcgggcacttttaccagtggtttgggattttctccatcgcctgttttgtgggaagtgtttcgatcatttggctgattctcatctttcggatgaagaatcctgcccatcaaaagaatctctacctctcactcctagagtatccaagggagcgattttcgcgtcttttggagatggaaggggtgctagagtggtatgtgaatgagaatgagagagtggcgattgtgaagtatgaccaaagtagcgtgagcggcgagacgattttagagagaatgaagtaa

SEQ ID NO: 625 - protein, 437 aa, Wolinella succinogenes
MIKQVLPLSGILALRFFGLFIVMPVLSLYALEMEGATPILMGIAIGGYALTQVLLQIPFGLVSDRIGRKKTIFFGLLVFVLGSVVCAMAESIEMLIVGRFLQGAGAIGGVVSAMIADLVKEERRTKAMAVMGATISMSFTAAMILGPIIGSSFGVDKLFWLTALLASLAILVLFINVPEAPLVSYSFEAEESRWQEVLHDKNLQLMNLTNFLQKAFMTLAFLIIPLALVKGMHFEHQDLWKVYIPAAILGVLSMAPAAILAEKKGYFKGVLLFGIVMFALSYTCMVSREPWLFILGVMLFFIGFSAHEPIMQSLASKYAKAHQKGAALGVFTSFGYLGSFFGGLLGGHFYQWFGIFSIACFVGSVSIIWLILIFRMKNPAHQKNLYLSLLEYPRERFSRLLEMEGVLEWYVNENERVAIVKYDQSSVSGETILERMK

SEQ ID NO: 626 - DNA, 1182 bp, Geobacter sulfurreducens
  CDS (1)..(1182)
atgttttcaggcatctccggcaacgtgctcatcctgggggtggtcagcttcctgaccgatgtctccagtgagatgatctatccgctactccccctcttcctgacgactgtgctcggtgccggccctgcgtttctcggcgtgatcgaaggagtggccgaatcgaccgcggcgctgctgaagctcgtctccggcatcgtgtccgaccggaccagaagccgcaaggggctggttctgggggggtacgccctgtcgagcctggcacgtcccctggtggctgcggcaacgggcccggtcgcggtactggccatccgcttcgccgaccgggtggggaagggggtgcggacctccccccgggatgctctcatcgccgactcttccgatccctcggtccgggggaaggcctatggctttcaccgggccatggatcacgccggagccctcgtgggccccctgctcgccaccctgctcctggccggcgccgccctggacctgcggaccgtgttctggctctcggccgtaccagggcttctggccgtacttctcatcattttgcgggtccgcgacgtggagcggaagcgaaccagcgacggaagcgttctgggggcgatacccagggatgggctccgccggtacctggccgtcctcgtcctgttcacgctgggcaattcctccgacgccttcctgctgctgcgggcgagccagctcggggtttcgccggcgcgcatcccgctgctgtgggccttttttcacctggtgaagatgctggcgtccactcccttcggcgccctgtcggaccggatcggccgtcggcgggtcatcgttgccggctgggcagtctacgccctgtcgtacctggggtttgccgctgccgcatccgagccggcctgctggctgctcttcgccgtctacggcaccttctacgggatgaccgaagggaccgaaaaggcgttcgtcgccgatctcgtccccgccgaggcccggggcggcgcctttggctggtaccatttcgccgtgggcgtcggggcgctgccggccagcgtgctcttcgggttgatctgggagagggccgggcagggagcggcatttctgttcggcgcggcgctggcagccctggcgtcaatcctgctgctcgtcctggtgagggaggacccgccggaggcgcagagcccgcggagctcctaa

SEQ ID NO: 627 - protein, 393 aa, Geobacter sulfurreducens
MFSGISGNVLILGVVSFLTDVSSEMIYPLLPLFLTTVLGAGPAFLGVIEGVAESTAALLKLVSGIVSDRTRSRKGLVLGGYALSSLARPLVAAATGPVAVLAIRFADRVGKGVRTSPRDALIADSSDPSVRGKAYGFHRAMDHAGALVGPLLATLLLAGAALDLRTVFWLSAVPGLLAVLLIILRVRDVERKRTSDGSVLGAIPRDGLRRYLAVLVLFTLGNSSDAFLLLRASQLGVSPARIPLLWAFFHLVKMLASTPFGALSDRIGRRRVIVAGWAVYALSYLGFAAAASEPACWLLFAVYGTFYGMTEGTEKAFVADLVPAEARGGAFGWYHFAVGVGALPASVLFGLIWERAGQGAAFLFGAALAALASILLLVLVREDPPEAQSPRSS

SEQ ID NO: 628 - DNA, 1119 bp, Rhodopseudomonas palustris
  CDS (1)..(1119)
atgctcggcaatttcgtcaccggaacctcggttctggcaccggccggtatgttgccggatctggcggccgggctcggggtgacgatccgcgacgccgggctactgatcaccttcggggcgatcgtgctgtgcatcggctcgccgctcaccgcctggctgaccagccggatcgatcgccggctgctgctgacgacgacgctcgcggtgctggcgctcggcaatctcgcctccgcctttgcgccgaactatgcggtgctgctggtgctgcggctggcgatgctgtcggtcggcgcgctgtacacgccgcaggccgccggcgcggtggcgctgatcgtgccgcctgaaagccgcggcggcaccatggcctatgtgtttctcggctggtcgcttgcggtggcgctcggcgtgccgctggtcaccttcgcggccgatcatgccggctggcgcggtgcctatctcaccgtcggcagcatcggcctgatcagcttcatcctgctgtggctgcggctgccgagcggcctgacagcggcgccggtgagcctgcgcacctgggccgccgtggggcgcaaccggcgcatcctgacgctgctcggggtgtcgtcgctgcagacctccgggcagttcgtggtgttcaccttcttcgggccgctgctcaccgggctgaccggcgccgggccgcgcgagatcgctttggtgttcgcgatctacggcgtctgcggcttcgtcggcaacgtgatcgccagccgcatcgtcgacggctggggtgcgtaccgcacctcggcgctgttcaccgcgctgatgctggccggcatagccggctggaccttcgcggccgggcacttcgcagtgatggcggcggcggtggcggtgtgggggctcggctttgcggcgtcgaactcgatgcagcaggtccggctggtcacggccgatccgatgctcgccggcgcaacggtgtcgctcaatacctcggtgctgtatgtcggccaggcgatcggctcggcgctcggtggcacgctgttcgccgccgggttgctgcacgtcaacggctacgtctctactgctgtgctgactcttgcgctgtgcatggtggtggttgcgacccgcgaccgcaacgcttaa

SEQ ID NO: 629 - protein, 372 aa, Rhodopseudomonas palustris
MLGNFVTGTSVLAPAGMLPDLAAGLGVTIRDAGLLITFGAIVLCIGSPLTAWLTSRIDRRLLLTTTLAVLALGNLASAFAPNYAVLLVLRLAMLSVGALYTPQAAGAVALIVPPESRGGTMAYVFLGWSLAVALGVPLVTFAADHAGWRGAYLTVGSIGLISFILLWLRLPSGLTAAPVSLRTWAAVGRNRRILTLLGVSSLQTSGQFVVFTFFGPLLTGLTGAGPREIALVFAIYGVCGFVGNVIASRIVDGWGAYRTSALFTALMLAGIAGWTFAAGHFAVMAAAVAVWGLGFAASNSMQQVRLVTADPMLAGATVSLNTSVLYVGQAIGSALGGTLFAAGLLHVNGYVSTAVLTLALCMVVVATRDRNA

SEQ ID NO: 630 - DNA, 1218 bp, Lactobacillus johnsonii
  CDS (1)..(1218)
atgagaattacgataaaatcagataagccaatttggaaaaagaatctttatgttctctctatcgccgtatttatcgcaggaatcgcattttcagagattatgcccttcctacctctatatatcgatactttaggacattttactcaccaacagttaaacttttggtcgggatttattttttccggagtgtacttcgtctcagctattatttcaccatggtggggtaaattagctgataaaaaaggtagaaaactaatgattctcagggcttcccttgggatggcccttgtccttggaagtatgggattagttactaatgtctggcaactatttttcttaagaatgttgcagggagtttttgcaggatttgtttcaaattcaaatgctttaatcgctacagaaacacctaaagaaaaatctggtcaagcgctaggaacaatggcctcttcttttactgccgggaacttacttgggcctttcttaggtggagcacttgcgtctgcatttagttaccgcgttactttctttatcacaggaggattattattaatctcctttcttctctcacttttctttgtccatgaagaaggatttaagccgattacagaaaagaaattagataaagccagcggcgttattgctactctacgatctccaaccctgatatttggtttactgttaaccactttaattatccaagcagccaacaattcaattaacccaattgtttctctatatgttaaacaattgatgagtggacatggaaatgttgtttttgtttctggaattattgccgctttacctggaattgcaacatttttagctgcttcacgttttggcgcattaggagataaaatcggcactcacaaaattattatcggtggttttattggtgcaacaattttattctttttgactgcctttgttcacaatacagtacaactaggtattttacgctttttagttggttttactgacgcatgtcttttcccacaagtacagactttactaaccaaaaattcacctgccgccgttactggtcgaattttttcttggaatcagagtgcaatgtatattggaaatattgcggggcctcttctaggatctttcattgccggaatttcaagctatagtatggttttcattgtgacagcagggattgttgtcttaaacttaatcttgtttaattttaatgttgtaaaaaatctttccaaataa

SEQ ID NO: 631 - protein, 405 aa, Lactobacillus johnsonii
MRITIKSDKPIWKKNLYVLSIAVFIAGIAFSEIMPFLPLYIDTLGHFTHQQLNFWSGFIFSGVYFVSAIISPWWGKLADKKGRKLMILRASLGMALVLGSMGLVTNVWQLFFLRMLQGVFAGFVSNSNALIATETPKEKSGQALGTMASSFTAGNLLGPFLGGALASAFSYRVTFFITGGLLLISFLLSLFFVHEEGFKPITEKKLDKASGVIATLRSPTLIFGLLLTTLIIQAANNSINPIVSLYVKQLMSGHGNVVFVSGIIAALPGIATFLAASRFGALGDKIGTHKIIIGGFIGATILFFLTAFVHNTVQLGILRFLVGFTDACLFPQVQTLLTKNSPAAVTGRIFSWNQSAMYIGNIAGPLLGSFIAGISSYSMVFIVTAGIVVLNLILFNFNVVKNLSK

SEQ ID NO: 632 - DNA, 1239 bp, Bdellovibrio bacteriovorus
  CDS (1)..(1239)
atgttttccaaacaagaaaagttccttctcgcgatcctggcttccatacagttcagttccatcgtggacttcatgatcatgatgccgctggggccgcagttgatgcgcatgtttgcaatcaatccgcaccagttcggactcctcgtgtcatcgtacaccttctttgcgggcctcagcggctttgccgcctctttctttctggacaaatttgatcgcaaggcctgcttgctgtttttcttcgttggtttctctgtcggcaccgtggcctgcggtctggcgccaaactatgagatgctgcttttggcccgcggcctgacgggtgtctttggcggtgtcctgggatcgctggttctatccatcgtcagcgatgcgatttcttacgagcgtcgcggcagcgccatgggggtcatcatgacttcgttttccatggcgtccattctgggagttcccttcagtttgttcctggcgaatcagttcaactggcacgctccgtttatcttcctgggctgcacttcactgctgctttgtgtggtgatctggttcaaagtaccgtccatgagcaaacaccttgaaggcggtgttaacaaagagccgatgtggaacacaatatcccgcatcgccaacaacaaaaaccaacgccgtggcttgtatttcatgtcatctgtgatgttcggccactttgccatcatcccgttcctgtccccgtcactggtggccaacgcaggattgagtgaatctcaactgcccttgatgtacatgattggcggagcctttacgatcttcagctcgccatttatcggccgcatggccgatcgctatggcaaacacaaggtcttcttgtggggcgctttggtgacgttgatcccgtattgggtgatcaccaatctggggcccagccctctgtgggtggtgctggcgatttgtgctttcttctttgtggtttccggcggacgcatgattccggcgacagccctggtgtccggcacagcaaaaccgcaaaaccgcggaagcttcatgagtatcgtcagctgcgtgcagcaactgtcgtcagcggtttcaagttacatcggcggattgatagtcacaaccggtgccaacggaaggttggaacactatccggtggtgggttacattgcgattgctttcacctttgtggcaatcttcctgtcccgccgtattgaggcggtcgaaggcggtggcccagcttccgtcgagcctgtggcagaacctgtgatctaa

SEQ ID NO: 633 - protein, 412 aa, Bdellovibrio bacteriovorus
MFSKQEKFLLAILASIQFSSIVDFMIMMPLGPQLMRMFAINPHQFGLLVSSYTFFAGLSGFAASFFLDKFDRKACLLFFFVGFSVGTVACGLAPNYEMLLLARGLTGVFGGVLGSLVLSIVSDAISYERRGSAMGVIMTSFSMASILGVPFSLFLANQFNWHAPFIFLGCTSLLLCVVIWFKVPSMSKHLEGGVNKEPMWNTISRIANNKNQRRGLYFMSSVMFGHFAIIPFLSPSLVANAGLSESQLPLMYMIGGAFTIFSSPFIGRMADRYGKHKVFLWGALVTLIPYWVITNLGPSPLWVVLAICAFFFVVSGGRMIPATALVSGTAKPQNRGSFMSIVSCVQQLSSAVSSYIGGLIVTTGANGRLEHYPVVGYIAIAFTFVAIFLSRRIEAVEGGGPASVEPVAEPVI

SEQ ID NO: 634 - DNA, 1212 bp, Escherichia coli
  CDS (1)..(1212)
atgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcggaatgctggcggaccgttatggtcgcaagcgcattttgattggctcagttgcgctgtttggtttgttctcactggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacagtctgcgccaccactgcgtgccttatttgcgccagaaacggcaaccgcgacgctgctgctgtggttgtgttatttcttcactctgctggtggtctacatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcacgaatacagccgtgcgccgatgcctaa

SEQ ID NO: 635 - protein, 403 aa, Escherichia coli
MSTRTPSSSSSRLMLTIGLCFLVALMEGLDLQAAGIAAGGIAQAFALDKMQMGWIFSAGILGLLPGALVGGMLADRYGRKRILIGSVALFGLFSLATAIAWDFPSLVFARLMTGVGLGAALPNLIALTSEAAGPRFRGTAVSLMYCGVPIGAALAATLGFAGANLAWQTVFWVGGVVPLILVPLLMRWLPESAVFAGEKQSAPPLRALFAPETATATLLLWLCYFFTLLVVYMLINWLPLLLVEQGFQPSQAAGVMFALQMGAASGTLMLGALMDKLRPVTMSLLIYSGMLASLLALGTVSSFNGMLLAGFVAGLFATGGQSVLYALAPLFYSSQIRATGVGTAVAVGRLGAMSGPLLAGKMLALGTGTVGVMAASAPGILVAGLAVFILMSRRSRIQPCADA

SEQ ID NO: 636 - DNA, 1182 bp, Salmonella typhimurium
  CDS (1)..(1182)
atgcacaacagtcccgccgccgctgcgcctaaatcgtttgacctgacgtctaccgcctttttgatcgtcgcttttctcaccggtattgccggtgcgttacagacgccgacgctcagtatttttctgacggatgaggttcacgcccgtcccggcatggtgggtttcttttttaccggcagcgcggttatcggcattatcgtgagccagtttctggcgggtcgctcagataaaaaaggcgatcgcaaaaaactgatcgttttctgttgcgtgctgggcatgttggcctgcgtgttgtttgcctggaaccgcaactactttattttgctgttcatcggcgtctttctcagtagcttcggctctaccgccaacccgcagatgtttgcgctcgcccgtgaacatgccgatcgtacaggtcgtgaagcggtgatgttcagctcaatcctccgcgcccaggtctcattggcctgggtcattgggccgccgctggcctatgcgctggcgatgggttttagctttacggtgatgtatttgagcgcggcggtagcttttatcgtctgcggcgtcatggtgtggttctttttaccgtcaatgcgcaaagatgcgccgctggcaaccggcacgctggaagcaccgcgtcgtaatcgccgcgatacgctgttgctgtttgtcatctgtacgttaatgtggggaactaacagcctgtatatcattaatatgccgctgtttatcatcaatgagctgcatcttccggaaaaacttgcaggcgtgatgatgggcaccgccgccgggctggagattcccacaatgctgattgcaggttacttcgccaaacggttgggaaaacgcctgttaatgtgcatcgccgttgtcgccggactgtgcttttatgtgggtatgttgctggcgcacgcaccggcgacgttgctcggcttgcagttgctgaacgcgatttacatcggcattcttggcgggattggcatgctctattttcaggatctcatgccaggccaggcgggttcagccaccacgctgtataccaataccattcgcgtcggctggatcattgccggttcgctggcgggaatcgccgcagaaatctggaattaccatgcggtcttctggtttgcgttagtcatgattgtcgccaccatgttctgcctggcgcgtattaaagatgtttaa

SEQ ID NO: 637 - protein, 393 aa, Salmonella typhimurium
MHNSPAAAAPKSFDLTSTAFLIVAFLTGIAGALQTPTLSIFLTDEVHARPGMVGFFFTGSAVIGIIVSQFLAGRSDKKGDRKKLIVFCCVLGMLACVLFAWNRNYFILLFIGVFLSSFGSTANPQMFALAREHADRTGREAVMFSSILRAQVSLAWVIGPPLAYALAMGFSFTVMYLSAAVAFIVCGVMVWFFLPSMRKDAPLATGTLEAPRRNRRDTLLLFVICTLMWGTNSLYIINMPLFIINELHLPEKLAGVMMGTAAGLEIPTMLIAGYFAKRLGKRLLMCIAVVAGLCFYVGMLLAHAPATLLGLQLLNAIYIGILGGIGMLYFQDLMPGQAGSATTLYTNTIRVGWIIAGSLAGIAAEIWNYHAVFWFALVMIVATMFCLARIKDV

SEQ ID NO: 638 - DNA, 1182 bp, Erwinia chrysanthemi
  CDS (1)..(1182)
atgacaatttcttctgcccgcacggcccgacgcctgcccgatctgacgtcttcggcgtttctggtgattgcttttctgaccgggattgccggtgcgctgcagctccccacgctcagtctgtttttatcaacggaagtacaggtacgcccgttcatggtcgggctgttttataccggcagcgcggtgatcggcatcgtcgtcagccagattctggcgacctattccgatcgtcagggcgaccgcaagacgctgatattgcaatgctgcctgttgggcgcgctggcctgcctgctgtatgcctggaaccgtaactatttcgtactgctgtttatcggtgtgctgctgtcgagtttcggctccaccgccaacccgcaactgtttgcgctggcgcgggaacacgccgaccgcaccggccgcggcgccgccatgttcagttcggtaatgcgggcgcagatttcgctatcctgggtgatcgggccgccggtcgccttcgcgctggcgctgggtttcggtttcccggcgatgtacctgacggcggcggtggtattcgtactgtgcggactgctggtgtggctgctgttgccgtcaatgcccaaaacccgggttaaatccgccgcgacgctggagtcgccccggcagaaccggcgcgacacgctattgctgtttaccgcctgtacgctgatgtggacctgcaacggcatctatctgatcaatatgccgttgtatctggttaatgaattgcggttaccggaaaagctggccggggtcatgatgggcaccgccgccgggttggaaatcccggtgatgctgctggccggctacctcaccagccggttaggcaagcgcctgctgatgcggctggcggtgatcgccggactgattttttataccgggctgacgctgctgaacggttcgtgggcgctgctggcgctgcaattgctgaacgcgattttcatcggcattctggccgggatgggaatgttgtactttcaggacctgatgccaggccaggcgggcgccgccacgacgctgttcaccaacaccacccgcgtaggctggattatctccggttcgctggcgggcatcgtggccgaagtctggagttatcatgcgggttttgttatcgccatcgccatgctggccggcgccgccgtctgcatgtggcgcatccgcgacgtttaa

SEQ ID NO: 639 - protein, 393 aa, Erwinia chrysanthemi
MTISSARTARRLPDLTSSAFLVIAFLTGIAGALQLPTLSLFLSTEVQVRPFMVGLFYTGSAVIGIVVSQILATYSDRQGDRKTLILQCCLLGALACLLYAWNRNYFVLLFIGVLLSSFGSTANPQLFALAREHADRTGRGAAMFSSVMRAQISLSWVIGPPVAFALALGFGFPAMYLTAAVVFVLCGLLVWLLLPSMPKTRVKSAATLESPRQNRRDTLLLFTACTLMWTCNGIYLINMPLYLVNELRLPEKLAGVMMGTAAGLEIPVMLLAGYLTSRLGKRLLMRLAVIAGLIFYTGLTLLNGSWALLALQLLNAIFIGILAGMGMLYFQDLMPGQAGAATTLFTNTTRVGWIISGSLAGIVAEVWSYHAGFVIAIAMLAGAAVCMWRIRDV

SEQ ID NO: 640 - protein, 505 aa, Consensus
  misc_feature (1)..(68): Xaa can be any naturally occurring amino acid
  misc_feature (70)..(90): Xaa can be any naturally occurring amino acid
  misc_feature (92)..(96): Xaa can be any naturally occurring amino acid
  misc_feature (98)..(145): Xaa can be any naturally occurring amino acid
  misc_feature (147)..(178): Xaa can be any naturally occurring amino acid
  misc_feature (181)..(401): Xaa can be any naturally occurring amino acid
  misc_feature (403)..(410): Xaa can be any naturally occurring amino acid
  misc_feature (412)..(505): Xaa can be any naturally occurring amino acid
XXXXXXXXXXXXXXXXXXXXXXXXXXXXXXXXXXXXXXXXXXXXXXXXXXXXXXXXXXXXXXXXXXXXGXXXXXXXXXXXXXXXXXXXXXDXXXXXRXXXXXXXXXXXXXXXXXXXXXXXXXXXXXXXXXXXXXXXXXXXXXXXXAXXXXXXXXXXXXXXXXXXXXXXXXXXXXXXXXGPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 641 - DNA, 1167 bp, Escherichia coli
  CDS (1)..(1167)
gtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttga

SEQ ID NO: 642 - protein, 388 aa, Escherichia coli
VKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 643 - DNA, 26 bp, Primer
atgaaacatctgcatcgattctttag

SEQ ID NO: 644 - DNA, 25 bp, Primer
ttaaactgatggacgcaaacgaacg

SEQ ID NO: 645 - DNA, 1152 bp, Vibrio parahaemolyticus
  CDS (1)..(1152)
atgaacgatgtcatccgtgactttttcaaaatggaatccgcaggtggtattcttctcgtgattgcagcggcaatagcgatgaccattgcaaactcaccactgggcgaaacttatcaatctctactgcatacttatgtatttggtatgtctgtttctcactggatcaacgacggtctgatggctgtgttcttcctacttattggccttgaagtaaagcgcgagctgcttgaaggcgcgttaaaatcgaaagaaactgccatcttccctgcaattgctgcggtcggtggtatgttggctccggcacttatttacgttgcttttaatgcaaatgaccctgaagcgatctctggttgggcaattcctgcggcgacagacattgcatttgctctgggtatcatggcattacttggtaagcgcgtaccagtgagcctaaaagtatttttgttggctcttgcgatcattgacgacttaggtgttgtagtcatcattgctctgttctacaccggtgatctttcttcaatggcattgcttgtcggcttcgtcatgacaggtgtactgttcatgctgaacgcgaaagaagtcaccaagctaacaccgtacatgattgtaggtgcgattctgtggtttgctgtacttaagtctggtgttcacgcaacattggcaggtgttgtgatcggtttcgcgattccgctgaaaggaaagcagggcgaacactctccactgaaacacatggagcatgctcttcacccttatgtcgcatttggtattcttcctctgtttgcatttgcgaacgcaggtatctcgctagaaggcgtatcgatgtctggcctaacttcaatgctgcctctaggtattgcactaggtctattgattggtaagcctctaggtatcttcagctttagctgggcagctgtgaaactgggcgttgcgaagctaccagagggtataaacttcaagcatatcttcgcggtatcagtgttgtgtggtatcggttttacgatgtcgatctttatctcttcactggcgttcggtaacgtaagccctgagtttgatacatacgctcgattaggtattttgatgggctcaactactgcagcggtacttggttacgctctactgcatttctcattaccaaagaaagcacaagactaa

SEQ ID NO: 646 - protein, 383 aa, Vibrio parahaemolyticus
MNDVIRDFFKMESAGGILLVIAAAIAMTIANSPLGETYQSLLHTYVFGMSVSHWINDGLMAVFFLLIGLEVKRELLEGALKSKETAIFPAIAAVGGMLAPALIYVAFNANDPEAISGWAIPAATDIAFALGIMALLGKRVPVSLKVFLLALAIIDDLGVVVIIALFYTGDLSSMALLVGFVMTGVLFMLNAKEVTKLTPYMIVGAILWFAVLKSGVHATLAGVVIGFAIPLKGKQGEHSPLKHMEHALHPYVAFGILPLFAFANAGISLEGVSMSGLTSMLPLGIALGLLIGKPLGIFSFSWAAVKLGVAKLPEGINFKHIFAVSVLCGIGFTMSIFISSLAFGNVSPEFDTYARLGILMGSTTAAVLGYALLHFSLPKKAQD

SEQ ID NO: 647 - DNA, 1203 bp, Haemophilus influenzae
  CDS (1)..(1203)
atgaattttttgctatgtatttttaaaggggtttatgtgataaaactgatccaacgtttttttaaattagaatctgctggcggtatattattgcttttttcagctgttgttgcgatgttgctggctaattcgccgttaagcaaccaatataatgattttttaaatttgcctgtaagtttacaaattggtagtttctcaattaataaaaccttaattcactggattaacgatggttttatggcggtgttttttgtattagtgggaatggaagtcaaaaaagaattatttgaaggcgcgctttctacctatcaacaagctattttccctgctattgcagctattggcggaatggttataccggctgtagtttattggtttatcgctaaacaagatccaagtttagctaatggctgggcaattccaatggcaacagacattgcttttgcactgggaattatggcgttattgagtaaacaagtgccacttccactgaaaatatttttacttgcccttgctattattgatgacctcggtgcgatagttgttattgcattatttttctcgcacggattgagtgtgcaagcactaattttttctgccgtggcaattattgtgctgatattactaaatcgtttcagagtttctgcactttgcgcttatatggtcgtaggtgcaattttatgggcttccgtattaaagtctggtgtgcatgctactttagcaggcgttattattggttttagcattccattgaaaggtaaaaaaggagaacgcccattagatgatttcgagcatattttagcctcttggtcatctttcgttattttaccacttttcgcatttgccaatgctggtgtgagttttgcaggcatagatgtgaatatgatttcgtcgccattattattggctatagcaagcggtttaattattggtaaaccagtcggtatatttggatttagttatatttctgttaaattgggattagctaaattaccggatggaattaattttaaacaaatttttgctgttgcggttttatgtggaatcggttttacgatgtcaatgttcttagcaagccttgcgtttgatgctaatgcgggggaaagtgtcaatactctttctcgtttaggtattctacttggatcaacggtttcggcaatacttgggtatttattcttaaaacaaacgacaaaactaaactaa

SEQ ID NO: 648 - protein, 400 aa, Haemophilus influenzae
MNFLLCIFKGVYVIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFRVSALCAYMVVGAILWASVLKSGVHATLAGVIIGFSIPLKGKKGERPLDDFEHILASWSSFVILPLFAFANAGVSFAGIDVNMISSPLLLAIASGLIIGKPVGIFGFSYISVKLGLAKLPDGINFKQIFAVAVLCGIGFTMSMFLASLAFDANAGESVNTLSRLGILLGSTVSAILGYLFLKQTTKLN

SEQ ID NO: 649 - DNA, 1317 bp, Helicobacter pylori
  CDS (1)..(1317)
atgaatctcaaaaaaacagaaaacgcgctcagtttgacgcttaagaacttcattaaaagcgagtcttttggagggattttcctctttttaaacgctgttttagcgatggtggtggctaattcgtttttaaaagaaagttattttgcactatggcacaccccttttgggtttcaaataggggattttttcatcggctttagtttgcacaactggattgatgatgtcttaatggcgttattctttttaatgataggcttagaaatcaaacgagaattgttgtttggggaattatccagtttcaaaaaagcttcttttcctgtgattgcggccatagggggcatgatagccccaggattgatttatttttttcttaacgctaacacgccttcccagcatggttttgggatccctatggcgacggatattgcgttcgctttaggcgtgatcatgcttttaggcaagagggtgccaaccgctttaaaggtttttttaatcactctagcggtggctgatgacttgggggctattgtggtgatcgcgctcttttataccacgaatttaaaattcgcatggcttttaggggctttaggggtggttcttgttttagccgtattaaaccgcctgaatatgcgctcgctcatcccttacttgcttttaggggtgttgctttggttttgcgtgcatcaaagcggtatccatgcgacgattgctgcagtgattctagcttttatgataccggtgaagatccctaaagattctaaaaatgtagagcttttggaactaggcaaacgatacgcagaaacgagttcaggagcgcttttgagtaaagagcagcaagaaatcttgcattctattgaagaaaaagcgagcgccttacaaagccccttagaaagattggagcattttctagcccccattagcgggtatttcatcatgcccttattcgcgtttgcaaacgctggggtgagcgttgattctagcatcaatttagaagtggataaggtgcttttaggggttattttagggctttgcttgggcaaacctttagggattttcttaatcacttttataagcgaaaagcttaaaatcaccgcacgccctaaaggcatcagctggtggcatattttaggggctgggcttttagcagggattggctttaccatgtctatgtttatttctaatctggccttcacgagcgagcataaagacgctatggaagtggcaaaaattgcgattttactcggatctttgatttctgggatcataggggctttgtatttatttgcgctagacaaaagagcggctttaaagaaataa

SEQ ID NO: 650 - protein, 438 aa, Helicobacter pylori
MNLKKTENALSLTLKNFIKSESFGGIFLFLNAVLAMVVANSFLKESYFALWHTPFGFQIGDFFIGFSLHNWIDDVLMALFFLMIGLEIKRELLFGELSSFKKASFPVIAAIGGMIAPGLIYFFLNANTPSQHGFGIPMATDIAFALGVIMLLGKRVPTALKVFLITLAVADDLGAIVVIALFYTTNLKFAWLLGALGVVLVLAVLNRLNMRSLIPYLLLGVLLWFCVHQSGIHATIAAVILAFMIPVKIPKDSKNVELLELGKRYAETSSGALLSKEQQEILHSIEEKASALQSPLERLEHFLAPISGYFIMPLFAFANAGVSVDSSINLEVDKVLLGVILGLCLGKPLGIFLITFISEKLKITARPKGISWWHILGAGLLAGIGFTMSMFISNLAFTSEHKDAMEVAKIAILLGSLISGIIGALYLFALDKRAALKK

SEQ ID NO: 651 - DNA, 1242 bp, Caulobacter crescentus
  CDS (1)..(1242)
atgctgcaacgcgtccgcaaactgtcccttctgagagagcttctggaaagcggggccgccggcggtctgcttctgatggcctgcgccgttcttgccctcttcgtcgccaactcgccgctggcggagggctatttccacgccctgcatgtcccgttcgccgggcttgatctgctgcactggatcaacgacggcctgatggcgatcttctttctgttcgtcggcctggagatcaagcgagagttcctggacgggcagttgtcgacctgggccaaccgcgcgctgccatgcatcgctgcggcggggggcgtcgttgttccaggcctcatctacgcaagtctgaacgccggcagtccagagacgctgcgcggctgggcaattccgacggcgacggatatagccttcgcgctgggcgtcctctcgcttctgggatcacgcgtcccgaccagcctcaagatcttcctcgcgacgctggcgatcgtcgacgacctcgtggcggttctgatcatcgccgtgttctataccgctgaactcaacaccgccgccctgatgggcgcggcgctggtgacgctcgttctgctcggcttcaatcgactgaaggtgaagcggctcgcgccgtatctggtcatgggcgtggcgctgtggtggctggtccttctgtccggagttcatgcgaccatcgccggcgtggtgctggccatgaccatccccttgcacgcctcgaaggctgcgccggacgacgcgacctcgccgctgcatcgcctggagcatgcgctctcgccctgggtggccttcctggtggtgccgatcttcggcttcgccaatgcgggcctgtcgttcgccggcatgacgccgtcggtcctggcggagcccgtgacgctcggcgtggccctggggctgttcttcggcaagcagatcggcgtgttcggggcggcgtggctcgccatccgcctgggcgtcgcgcgcctgccggtggcggcctcctgggcgcagctctatggggtcagcctgctctgcggcatcggcttcaccatgagtctcttcattggtctgctggcgttccgcgatgcagcgctgcaaaacgaggtgaaggtcggcgtgctggtcggctcgctcagctcggccctgatcggcgcgaccctgctgagcctgacgaaaaggcggctaccggctgtcgatccgtcgcgcgatcatcaggctgacgccaccgcgttggacgacctcggccgcgaagacgcgcgctaa

SEQ ID NO: 652 - protein, 413 aa, Caulobacter crescentus
MLQRVRKLSLLRELLESGAAGGLLLMACAVLALFVANSPLAEGYFHALHVPFAGLDLLHWINDGLMAIFFLFVGLEIKREFLDGQLSTWANRALPCIAAAGGVVVPGLIYASLNAGSPETLRGWAIPTATDIAFALGVLSLLGSRVPTSLKIFLATLAIVDDLVAVLIIAVFYTAELNTAALMGAALVTLVLLGFNRLKVKRLAPYLVMGVALWWLVLLSGVHATIAGVVLAMTIPLHASKAAPDDATSPLHRLEHALSPWVAFLVVPIFGFANAGLSFAGMTPSVLAEPVTLGVALGLFFGKQIGVFGAAWLAIRLGVARLPVAASWAQLYGVSLLCGIGFTMSLFIGLLAFRDAALQNEVKVGVLVGSLSSALIGATLLSLTKRRLPAVDPSRDHQADATALDDLGREDAR

SEQ ID NO: 653 - DNA, 1149 bp, Vibrio cholerae
  CDS (1)..(1149)
atgtctgacatgattcgagatttcttcaagatggaatctgcggggggcattctgctggtgattgcggcggccattgctatggtcattgccaattcagcaatgggtgaagggtaccaagcatttttacatacctatgtctttggtatgtcggtttcacactggattaatgatggcctaatggcggtgtttttcttattgatcggtttagaggtcaaacgtgaactgctggaaggagcgctgaaatcccgtgaaacagcgattttccctgcgatagcggcggtaggcggtatgctcgctcctgcattaatctatgtagccttcaattttaacgatccggctgccattcaaggttgggcgattcctgcggccaccgatattgcgtttgcgctcgggatcatggcgctactgggtaagcgtgtgcctgtgagtttgaaagtgtttctgctggcgctggcgatcattgatgaccttggcgtagtagtgatcatcgctctgttttacagcagtgatttatcaaccattgcactcactatcggctttatcatgacgggtgtgctgtttatgcttaatgccaagcacgttactaaattgagtatttatttggtggcaggcctcatcctatggatcgccgtattaaagtcgggtgtccacgccacattggctggagtagtgatcggatttgctattccgctgaaaggcaataagggtgagcattcaccgttgaaacaccttgagcatgcactgcatccttatgttgcctttgcgattttacctgtgtttgcttttgccaatgctggtatctcactgcaaggcgtgtcattagcagggcttacttctatgctgccactgggtgtagcactgggtctgttccttggtaaaccactcggcatctttagcttcagttgggctgcggttaaactcggggtagcaaaactgccagaagggatcaacttcaagcatatttttgcagtatcggtactgtgtggcatcggttttactatgtcgatcttcatttcatcactggcctttggtcaagcgaatgaagcttatgatacttatgcgcgcttaggtattttaatggggtcaaccaccgcggcattacttggttattctttactgcgactctctctgccgctcaaaaaagcgtaa

SEQ ID NO: 654 - protein, 382 aa, Vibrio cholerae
MSDMIRDFFKMESAGGILLVIAAAIAMVIANSAMGEGYQAFLHTYVFGMSVSHWINDGLMAVFFLLIGLEVKRELLEGALKSRETAIFPAIAAVGGMLAPALIYVAFNFNDPAAIQGWAIPAATDIAFALGIMALLGKRVPVSLKVFLLALAIIDDLGVVVIIALFYSSDLSTIALTIGFIMTGVLFMLNAKHVTKLSIYLVAGLILWIAVLKSGVHATLAGVVIGFAIPLKGNKGEHSPLKHLEHALHPYVAFAILPVFAFANAGISLQGVSLAGLTSMLPLGVALGLFLGKPLGIFSFSWAAVKLGVAKLPEGINFKHIFAVSVLCGIGFTMSIFISSLAFGQANEAYDTYARLGILMGSTTAALLGYSLLRLSLPLKKA

SEQ ID NO: 655 - DNA, 1317 bp, Helicobacter pylori
  CDS (1)..(1317)
atgaatctcaaaaaaacagaaaacgcgctcagtttgacgcttaaaaacttcattaaaagcgagtcttttggagggattttcctctttttgaacgccgttttagcgatggtggtggctaattcgtttttaaaagaaagttattttgcgctatggcacaccccttttgggtttcaagtaggggatttttttatcggctttagtttgcacaactggattgatgatgtcttaatggcgttattctttttaatgataggcttagagatcaagcgagaattgttgtttggggaattatccagttttaaaaaagcttctttccctgtgatcgcagccatagggggcatgatagctccaggattgatttatttttttcttaacgccaacacgccctctcagcatggttttgggatccctatggcaacggatattgcgttcgctttaggcgtgatcatgcttttaggcaagagggtgccaaccgccttaaaggtttttttaatcactctagcggtggctgatgacttaggggctattgtggtgatcgcgctcttttataccacgaatttaaaattcgcatggcttttaggggctttaggggtggttcttgttttagccatattgaaccgcctgaatatccgatcgctcatcccttacttgcttttaggggtgttgctttggttttgcgtgcatcaaagcggtatccatgcgacgatcgctgcggtggttctagcttttatgataccggtgaaaatccctaaagattctaaaaatgtagagcttttggaattaggcaaacgatacgcagagacgagttcaggagtgcttttaaccaaagagcagcaagaaatcttgcattctattgaagaaaaagcgagtgctttacaaagccccttagaaagattggagcattttctagcccccatcagcgggtatttcatcatgcccttattcgcgtttgcaaacgctggggtgagcgttgattctagcatcaatttagaagtggataaggtgcttttaggggttattttagggctttgtttgggcaagcctttagggattttcttaatcactttcataagcgaaaagcttaaaatcactgcgcgccctaaaggcatcggctggtggcatattttaggggctgggcttttagcagggattggctttaccatgtctatgttcatttctaatctggctttcacgagcgaacataaggacgctatggaagtggcaaaaattgcgattttactcggatctttgatttctgggatcataggggctttatatttattcgcactagataaaagagcggctttaaagaaataa

SEQ ID NO: 656 - protein, 438 aa, Helicobacter pylori
MNLKKTENALSLTLKNFIKSESFGGIFLFLNAVLAMVVANSFLKESYFALWHTPFGFQVGDFFIGFSLHNWIDDVLMALFFLMIGLEIKRELLFGELSSFKKASFPVIAAIGGMIAPGLIYFFLNANTPSQHGFGIPMATDIAFALGVIMLLGKRVPTALKVFLITLAVADDLGAIVVIALFYTTNLKFAWLLGALGVVLVLAILNRLNIRSLIPYLLLGVLLWFCVHQSGIHATIAAVVLAFMIPVKIPKDSKNVELLELGKRYAETSSGVLLTKEQQEILHSIEEKASALQSPLERLEHFLAPISGYFIMPLFAFANAGVSVDSSINLEVDKVLLGVILGLCLGKPLGIFLITFISEKLKITARPKGIGWWHILGAGLLAGIGFTMSMFISNLAFTSEHKDAMEVAKIAILLGSLISGIIGALYLFALDKRAALKK

SEQ ID NO: 657 - DNA, 1233 bp, Streptomyces coelicolor
  CDS (1)..(1233)
atgtctgctccctcgcggatcactgctgccctgcgctcagacgcggtcggtggctctctgctgatcggcgccgccgtcatcgcgctcatctgggcgaactcgcccctgtcccactcctacgaggccctgcgctcgttcaccttcggcccttccgccctccacctgaacctgtccgtggagacgtgggcggcggacgggctgctggcggtgttcttcttcatcgtcggcaacgagctgaagcaggaactcgtccacggcgagctgcgcgacccacgccgcgcggccctgccgatcgccgccgcgctcggcggcgtcgccgtgcccgccctggtcttcctggccttcaccctcggctccggcggggaggcggccggaggctggggcatcccgatggctaccggcatcgccttcgccgtggccgtcctggcggtggtcggccggcacctgccgacgccgctgcggaccttcctgctcaccctggccaccgtggacgacatgtccgcggtcctggtcatcgccgtcgcctgcaccagcggcatcaacttcaccgccctcgccttggctgccgtcggcctggccgtgttcggctacttgcagaacgggtccgggcgggcggtggcccgggtgcgcgcgatggtcccggcgtggctgctgttcgtgccgctggccgcggtcgtctgggcgctgatgcacgcctgcggtgtacacgcgaccatcgccggggtcgtcatgggcctgttgatgcgcacccgcccccagggggcggagcgggtgtcgccctcgcaccgcgcggaggaggtcttgcgcccgttctccgccgggatcgcactgccgctcttcgcgctgatgtcagccggcgtctccctggccggggcgggaggcttcgtcacctccgccatcacctggaacgtcctcgccggcctgctcgtgggcaaggtcgtcgggatcttcggcggcacctggccgaccagccgcctcaccagcgcccacctcaacccgctgctcggctgggccgacatcgccgggatcgccgtgctgggcgggatcggcttcacggtctccctgccgatcgccgaactctcctccaccagccaggcgcatctcaccgacgccaagggcgccatcctcctggcctccaccaccgcggccctgctcgccgcgctcctgctgggccgccgcagccgccaccaccagcgcctcgcccgccaggccgcgcagcaggcgacgacgtaa

SEQ ID NO: 658 - protein, 410 aa, Streptomyces coelicolor
MSAPSRITAALRSDAVGGSLLIGAAVIALIWANSPLSHSYEALRSFTFGPSALHLNLSVETWAADGLLAVFFFIVGNELKQELVHGELRDPRRAALPIAAALGGVAVPALVFLAFTLGSGGEAAGGWGIPMATGIAFAVAVLAVVGRHLPTPLRTFLLTLATVDDMSAVLVIAVACTSGINFTALALAAVGLAVFGYLQNGSGRAVARVRAMVPAWLLFVPLAAVVWALMHACGVHATIAGVVMGLLMRTRPQGAERVSPSHRAEEVLRPFSAGIALPLFALMSAGVSLAGAGGFVTSAITWNVLAGLLVGKVVGIFGGTWPTSRLTSAHLNPLLGWADIAGIAVLGGIGFTVSLPIAELSSTSQAHLTDAKGAILLASTTAALLAALLLGRRSRHHQRLARQAAQQATT

SEQ ID NO: 659 - DNA, 1425 bp, Streptomyces coelicolor
  CDS (1)..(1425)
atgaccgcgccccgcaccccccgcaaagccttcggacggctgtccctgccggagcgcacctacctcgcggacgcgctgcgcaccgagaccgtcggcggcgtcctgctgctcgtcgccgcgatcgccgccctggtgtgggcgaacataccggcgctgcacgacagctacgagagcgtcagccacttccacttcggtcccgcggccctcggtctgaacctgtcggtcgcacactgggccgccgacgggcttctggcgatcttcttcttcgtcgccggcatcgaactcaaacgcgaactggtcgccggtgatctgaaggaccccaaggccgccgcgctcccggtggtggcggcgctgtgcggcatggtcgtaccggcggtcgtctacaccgtcaccagcaccgcgggcggcggctccctgtccggctgggccgtgccgaccgccaccgacatcgccttcgcgctcgccgtactcgccgtcatcggcacgtcgctgccgagcgcgctgcgcgccttcctgctgacgctcgccgtcgtcgacgacctgttcgccatcctgatcatcgcggtcttcttcaccgagaccctgaacttcgccgcgctgggcggcgcggtcgtcggcctcgcggtcttctggctgctgctgcgcaagggggtgcgcggctggtacgtgtacgtgccgctcggcctggtgatctgggccctcatgtacaacagcggcgtccacgccaccatcgccggcgtcgcgatgggcctgatgctgcgctgccaccggcgcgagggcgaggaccactcccccggcgagcacatcgaacacctggtgcgcccgctgtcggcgggcctggccgtgccgctgttcgcgctgttcagcgcgggtgtggccatcaccggcggggcgctggccgacgtgttcaccaagccggagaccctcggtgtcgtactcgggctcgtcgtcggcaagacgctgggcatcttcggcggcacctggctgacctcgcgcttcaccagggcttcgctcagcgacgacctccagtgggccgacgtgttcgcggtggcgaccctggccggcatcgggttcaccgtctcgctgctgatcggcgagctggccttcgaggacgacgcggcgatgacgagcgaggtcaaggccgccgtcctgaccggctcgctgatcgcggcggccctggccacggtgctgctgaagatacggaacgcgaagtaccgggggatggtcgcggaggaggagcgcgacgacgacctcagcggtgtccccgacatctacgaggaggacgaccccgcgtaccacctgcgggtggccgccatctacgagaagaaggccgccgagcaccgccggatcgccgaggagatggagtcggcgcggcttgccgaagtggcgggcggggcaggcgatgagggcgacggtccggcataa

SEQ ID NO: 660 - protein, 474 aa, Streptomyces coelicolor
MTAPRTPRKAFGRLSLPERTYLADALRTETVGGVLLLVAAIAALVWANIPALHDSYESVSHFHFGPAALGLNLSVAHWAADGLLAIFFFVAGIELKRELVAGDLKDPKAAALPVVAALCGMVVPAVVYTVTSTAGGGSLSGWAVPTATDIAFALAVLAVIGTSLPSALRAFLLTLAVVDDLFAILIIAVFFTETLNFAALGGAVVGLAVFWLLLRKGVRGWYVYVPLGLVIWALMYNSGVHATIAGVAMGLMLRCHRREGEDHSPGEHIEHLVRPLSAGLAVPLFALFSAGVAITGGALADVFTKPETLGVVLGLVVGKTLGIFGGTWLTSRFTRASLSDDLQWADVFAVATLAGIGFTVSLLIGELAFEDDAAMTSEVKAAVLTGSLIAAALATVLLKIRNAKYRGMVAEEERDDDLSGVPDIYEEDDPAYHLRVAAIYEKKAAEHRRIAEEMESARLAEVAGGAGDEGDGPA

SEQ ID NO: 661 - DNA, 1314 bp, Sinorhizobium meliloti
  CDS (1)..(1314)
atgaacgacagtctctcacggcttcccagggaaccggcagatcggcttaccaagccgtttatgcggttcctccggatcgaggccaccgcgggcattatccttttgctcagcacgctcttggcgctcggcctcgcaaataccgcgtggtcgtcgtcgtttctcgccttttgggagatgcccgcgggtgtcagactgggcgacatcgggatctatcgttcgctgaagcactggatcaacgacgggctgatgacgttttttttcttcgtcatcgcccttgagctgaagcgtgagctggtgctgggggagctgcgcaatccgcgcatggccgccctacccgtcgccgccgctctcgggggaatggctgcgccggccggaatctatttgctgcttgtcggcggggggccgggtgcgagcggctggggcaccgttatgtccacggacacggcgttcgtcatcggatgccttgctttgctcggttcccgcgtacctggtagcttgcgactgttcctgctctctcttgcgatcttcgacgacatcggcgcaatattgatcgtggcggtcggctatggcgaaccgttgaattgggtggcactcggaaccggaggactcggatttgccttcgtcgcaggaattgcgcttctgggcatccgcagcattccggtctatttcgcgatgggtagcgccatctggctggcattcgacgcatcgggcgttcacgcgacgctcgtcggagtgatacttggcttgatgacgccggcgcggaggtgggtaagcgagatccgcctccacgcgatactcgaccgggtgatcgcccatccccccggcgaccatcgcagccgtgacacggcggcacgcagcgaccttcatcgggcaggcgtcgcgacccgcgaagcagtgtcgccgatcgagcgtctcgagatcgccctccatccctgggtcgcattcgcaatcatgccgctctttgccgtctccaacgcgggcatcccgatagaggatgcaaacttcgacgttcccctcacgatcgcaattgtcgtcgccttcgtggtcggcaagccggctggcattgtgctcttcagtttcctcgccgtgaaacttcgcctcgcgagtcgtccggaacagctatcctggagcctgttggcggccggcagtctgctgaccgggatcggcttcaccatggctctgttcattgccgagcttgctttcgagcccgagcttctgatccccgtcaagctcggtgtgctcggcgcttccgtcatatcggccgcactcggttttatggcgctgaccttactgacgtctcctaatagacgataa

SEQ ID NO: 662 - protein, 437 aa, Sinorhizobium meliloti
MNDSLSRLPREPADRLTKPFMRFLRIEATAGIILLLSTLLALGLANTAWSSSFLAFWEMPAGVRLGDIGIYRSLKHWINDGLMTFFFFVIALELKRELVLGELRNPRMAALPVAAALGGMAAPAGIYLLLVGGGPGASGWGTVMSTDTAFVIGCLALLGSRVPGSLRLFLLSLAIFDDIGAILIVAVGYGEPLNWVALGTGGLGFAFVAGIALLGIRSIPVYFAMGSAIWLAFDASGVHATLVGVILGLMTPARRWVSEIRLHAILDRVIAHPPGDHRSRDTAARSDLHRAGVATREAVSPIERLEIALHPWVAFAIMPLFAVSNAGIPIEDANFDVPLTIAIVVAFVVGKPAGIVLFSFLAVKLRLASRPEQLSWSLLAAGSLLTGIGFTMALFIAELAFEPELLIPVKLGVLGASVISAALGFMALTLLTSPNRR

SEQ ID NO: 663 - DNA, 1185 bp, Yersinia pestis
  CDS (1)..(1185)
atgacaaatatcattcgtcaatttttacgccaagaggccgcaggtggcctgattctgattattgctgccgctatcgccttgttgatggcgaacagcgccctacaaggggtttatcaatcatttcttgatataccagtctcgataaaaatagcttcgctggatatcagtaaaccgttattactgtggattaacgatggtctaatggcggtgtttttcctgatgatcgggctggaagttaaacgtgagttgatggaaggctctttggcgggccgcgataaagcagttttccccgcgattgcggcattgggggggatgttagccccagcgctgatttacttactgttcaatggtgctgatgaggtgacccgccaagggtgggcgatcccggcagcgactgacattgcgtttgccttgggagtgatggcgctattaggtaaccgggtacccaccgggctgaaggtctttttactggcattagccattatcgatgaccttggtgtcattattattattgcgttgttctatacccagcaggtttcattacaatctttgggtattgctgcggctgctattgctttactggcgtatatgaactggcgtggtgtagggaaaacatcagcttatctgctggtcggcttggttttgtgggtctgtattcttaaatcgggtgtacatgcgactttggctggggtgattgttggctttatgatcccgctgcatacccaagaccaacgctctccttctgaatcgctggagcatggtttacatccgtgggttgcctatttaattttgccattgtttgcttttgccaatgcgggggtctctttacaaggcgtttctctttcagggctgacgtcactactgccaatggggattgcaaccggtctgtttatcggtaaaccgttgggaattttcacttttagttggctcgcggttaagttaggtattgctaaactacccgacgcaataaattttaagcaaatttttgcagtttcagtgttgtgtgggatcggctttactatgtcgatatttatcgcatcactggcatttgaaggcacagatatcgctctgacgacctattccaaactagggatattgctaggctctaccacagcggctgttgtgggttacagcttactgcgtttggttttacccgctcggcggaaggctgttaacgtaaggtaa

SEQ ID NO: 664 - protein, 394 aa, Yersinia pestis
MTNIIRQFLRQEAAGGLILIIAAAIALLMANSALQGVYQSFLDIPVSIKIASLDISKPLLLWINDGLMAVFFLMIGLEVKRELMEGSLAGRDKAVFPAIAALGGMLAPALIYLLFNGADEVTRQGWAIPAATDIAFALGVMALLGNRVPTGLKVFLLALAIIDDLGVIIIIALFYTQQVSLQSLGIAAAAIALLAYMNWRGVGKTSAYLLVGLVLWVCILKSGVHATLAGVIVGFMIPLHTQDQRSPSESLEHGLHPWVAYLILPLFAFANAGVSLQGVSLSGLTSLLPMGIATGLFIGKPLGIFTFSWLAVKLGIAKLPDAINFKQIFAVSVLCGIGFTMSIFIASLAFEGTDIALTTYSKLGILLGSTTAAVVGYSLLRLVLPARRKAVNVR

SEQ ID NO: 665 - DNA, 1170 bp, Campylobacter jejuni
  CDS (1)..(1170)
atgaataatatagtacataaattaaaaactttagttttaaatgaggcttttggcggcgttttacttatagtttgcactttgcttgctttgcttgtgcaaaacgggtcttttagcgaacattatcgagaatttctaaatttaaaagtcggatttagtgtaggtgaatttgagcttaacaagccttttttactttggataaatgatgggcttatatctatatttttctttgctatagggcttgagcttaagaaggaatttttgcacggagattttaaaaatcctaaaaatattgttttgccttttatggctgcgttagggggtatacttataccagcaatgttgtttgctttggtgaatataggagatgcttatactttaaaaggttgggcaatacctacagctacagatacagcgtttgccttagcgattttaatgatgtgcggcaagcacattccatcaagtttaaaaattttcttactttctttggctatttttgatgatgtgggtgctattttaattatagctattttttatacgacaaaattatcaatagctgcttttgtaattgcaggacttgctattttggtaatgcttattttaaatcttttagggataacaagaaagtctttttattttatttgctcagttattctttggattagtgttttaaaaagtggagtacatgcaactttagctggaattgtaacagcattttttataccgatgcaaactaaaaatggggaagcatttttagaagaaatttatgaaagcttaaaattttggattgcttttattattttacctttatttgcttttgctaacgctggagtaaatttatccaatatcgatataggagcaattttttcaggtgtaagtataggtattttcttagggctttttgtgggtaaacaagtgggtgtatttttattttcttatttggcaatccgctttaaatttgcagctttgccccaaggttcaaatttgaaacaactttatggggtttgcatacttacaggaattggttttacaatgagtttgtttattgatggattggcgtatgaagttagtgatatttttaattatgcagataacttagctattctcatagcctcattttgttctgggatttggggttttatttatcttaaattctttactactcgatcttaa

SEQ ID NO: 666 - protein, 389 aa, Campylobacter jejuni
MNNIVHKLKTLVLNEAFGGVLLIVCTLLALLVQNGSFSEHYREFLNLKVGFSVGEFELNKPFLLWINDGLISIFFFAIGLELKKEFLHGDFKNPKNIVLPFMAALGGILIPAMLFALVNIGDAYTLKGWAIPTATDTAFALAILMMCGKHIPSSLKIFLLSLAIFDDVGAILIIAIFYTTKLSIAAFVIAGLAILVMLILNLLGITRKSFYFICSVILWISVLKSGVHATLAGIVTAFFIPMQTKNGEAFLEEIYESLKFWIAFIILPLFAFANAGVNLSNIDIGAIFSGVSIGIFLGLFVGKQVGVFLFSYLAIRFKFAALPQGSNLKQLYGVCILTGIGFTMSLFIDGLAYEVSDIFNYADNLAILIASFCSGIWGFIYLKFFTTRS

SEQ ID NO: 667 - DNA, 1149 bp, Campylobacter jejuni
  CDS (1)..(1149)
atgcaaatgataaagaagatggttttaagtgaaactttccctggtattttgcttatattttttacatttttagctttattatgtaaaaattcttctttaagtgttatttatacagatttttttcatgctaattttacagtaggatttgatcattttcaaatttcaaaatcgttggatttatggataaatgatggtttgatagctatattttttctatgtatagggcttgagttaaaatatgaaattttacgtgggcaacttaaaaatataagagctgtatctttacctatatttggagctttagggggtatgattactccggctttaatttttattgctattaattattctcatgattttgctatgaaaggttgggcaatacctacagcaactgatatagcttttgcagtgggtattttaatgcttttgggaaataaaattcctacaagtttaaaactttttttgctctctttagctatttttgatgatttgggtgctattgttattattgctttgttttatacagatcagctttcagctttagcaattattatttgtttgttttgtatatttgctctgcttttgttaaattattatcacatcacccatctttctttgtacgtgttggtaggtgttgtgttgtggatagctatgcttaaaagtggagtgcatgcaactttggctggtgtgatcatttctttgtttatacctcttgatacaaaaaataaaaaaccttatttacatgaagttcttaaggatttaaatccttgggtagtttattttattttacctttatttgcttttgccaatgctggaattgatattagagatatgcatcttggttcagtattttctcctgtaagtcttgggattattttaggactatttttaggaaaacaattaggtgttttcactttttgttttattgctatcaaacttaaacttgcaaaattacctgaaaatattaaatatggaaaattttatggtatatgtattttaacaggcatcggttttacgatgagcttgtttattgatggtttggcttataaaaatagtgatatttttgaatatgcggataaacttgctattttagtagctagttttttaagtgccattgttggttttatttatcttaagattgttaaataa

SEQ ID NO: 668 - protein, 382 aa, Campylobacter jejuni
MQMIKKMVLSETFPGILLIFFTFLALLCKNSSLSVIYTDFFHANFTVGFDHFQISKSLDLWINDGLIAIFFLCIGLELKYEILRGQLKNIRAVSLPIFGALGGMITPALIFIAINYSHDFAMKGWAIPTATDIAFAVGILMLLGNKIPTSLKLFLLSLAIFDDLGAIVIIALFYTDQLSALAIIICLFCIFALLLLNYYHITHLSLYVLVGVVLWIAMLKSGVHATLAGVIISLFIPLDTKNKKPYLHEVLKDLNPWVVYFILPLFAFANAGIDIRDMHLGSVFSPVSLGIILGLFLGKQLGVFTFCFIAIKLKLAKLPENIKYGKFYGICILTGIGFTMSLFIDGLAYKNSDIFEYADKLAILVASFLSAIVGFIYLKIVK

SEQ ID NO: 669 - DNA, 1167 bp, Salmonella enterica subsp. enterica serovar Typhi
  CDS (1)..(1167)
atgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccagcattgctctatctggcctttaactactccgatccggtcactcgtgagggctgggctattcctgccgcgacggatatcgcctttgcgctgggcgtgctggcgctgttaggcagccgggttccgctggcgctgaaaattttcctgatggcgctggcgatcatcgatgacctcggcgccatcattattatcgcactgttttataccagcgatctttctatcgtctcgctgggcgtggcggcgttcgcgattgccgtgctggcgctgctgaacctgtgcggcgtcaggcggacaggggtatatattctggtcggggcagtgctgtggacggcggtactgaagtccggcgttcacgcgacgctggcaggcgtcattgtcggcttctttattccgctgaaagaaaaacacggacgctcgccggccaagcgtctggagcatgttctgcacccgtgggtcgcatacctgatcctgccgctcttcgcttttgcgaatgccggcgtttctcttcagggcgtcacgatggacggtctgacctccatgctgccgttgggaattattgctggtctgctgattggtaagccgctggggattagcctgttttgctggctggcgctgcgtttcaagctggcgcatctgccgcaggggaccacttatcagcaaatcatggcggtcggcattttgtgtggcattggctttacgatgtccatctttatcgccagcctggcatttggcaatatcgatccggaacttattaactgggcgaaattgggcattttgattggttcattgctctccgcagtggtggggtatagctggttgcgcgcgcgtttgaacgcgccggcataa

SEQ ID NO: 670 - protein, 388 aa, Salmonella enterica subsp. enterica serovar Typhi
MKHLHRFFSSDASGGIILIIAAALAMLMANMGATSGWYHDFLETPVQLRVGALEINKNMLLWINDALMAVFFLLIGLEVKRELMQGSLASLRQAAFPVIAAIGGMIVPALLYLAFNYSDPVTREGWAIPAATDIAFALGVLALLGSRVPLALKIFLMALAIIDDLGAIIIIALFYTSDLSIVSLGVAAFAIAVLALLNLCGVRRTGVYILVGAVLWTAVLKSGVHATLAGVIVGFFIPLKEKHGRSPAKRLEHVLHPWVAYLILPLFAFANAGVSLQGVTMDGLTSMLPLGIIAGLLIGKPLGISLFCWLALRFKLAHLPQGTTYQQIMAVGILCGIGFTMSIFIASLAFGNIDPELINWAKLGILIGSLLSAVVGYSWLRARLNAPA

SEQ ID NO: 671 - DNA, 441 bp, Rickettsia conorii
  CDS (1)..(441)
atggtggagtcaggtattcacgataccttatgcagagccattatagcactttttatacctgttaatataaaaggagaatttaacacttcttttaaaaaacttgaaaacttaactcgtccttttgtaaattactttattttaccgctttttgtatttatgaattccggtatccttttagaatattttgcatttaaaggcatttgttccaactcaatacttgctttaatttatgggataatatttggtttatttgtaggtaagcaattaggtattatgctattttcatatccatttgtaaaatttaaactctgtaacttaccaagtgatacttcatggttaaaattttattctatagctatacttggagggattggatttactctaagtttatttataggtagtattttacgtttgagagcagctgcccttcaaactctataa

SEQ ID NO: 672 - protein, 146 aa, Rickettsia conorii
MVESGIHDTLCRAIIALFIPVNIKGEFNTSFKKLENLTRPFVNYFILPLFVFMNSGILLEYFAFKGICSNSILALIYGIIFGLFVGKQLGIMLFSYPFVKFKLCNLPSDTSWLKFYSIAILGGIGFTLSLFIGSILRLRAAALQTL

SEQ ID NO: 673 - DNA, 1443 bp, Streptomyces antibioticus
  CDS (1)..(1443)
atggccgcgccccgcaccccgaacaccgcccgcaaggttctcggacgcctgtccctgcccgagcggaccttcgtcgcggacgcgctgcgcaccgagaccgtcggcggtgtcctgcttctcgtcgccacggtgacggcgctggtctgggcgaacatccccgcactgcagcacagctacgaggcggtcagccacttccacttcggcccgagcgccctcggcctgaacctgtccgtggcccactgggccgccgacggcctcctcgccgtcttcttcttcgtcgccggcatcgagctcaagcgcgagctggtcgccggggacctgcgcgaccccagggcggcggtgctgcccgtggtggccgcgctgtgcgggatggccgtaccggcgctcgtctacaccctcaccaacctcaccggacacggctccacccagggctgggcggtgcccaccgccaccgacatcgccttcgcgctcgccgtcctcgcggtcatcggcacctcgctgcccagcgccctgcgcgccttcctgctcaccctcgcggtcgtcgacgacctgttcgcgatcctgatcatcgcgatcttcttcaccgagcggatcaacttcgcggcgctcggcggggccgtcgccgggctggcggtcttctggctgctgctgcgcaagggcgtacgcggctggtacgtgtacgtgccgctggccgtcgtcgtctgggcgctgatgtacaacagcggcgtgcacgccaccatcgcgggcgtggcgatgggcctgatgctgcgctgcaccacccgtgagggtgaggagcactcgccgggcgagcacatcgagcacctggtgcggccgctgtcggccgggctcgccgtaccgctgttcgcgctgttcagcgccggggtggtggtctccggcggggcgctcggggatgtgttcaccgagccggagacgcttggggtggtgctcgggctggtcgtgggcaagacgctcggcatcttcggcagcacctggctgacggcccgcttcacccacgcggagctcagcgaggacctggaatgggccgacatcttcgcggtggcctccctcgccggaatcggcttcaccgtctcgctgctcatcggcgagctggccttcgcgggcgacacgctgctgaccgacgaggtgaaggcggccgtcctcaccggatcgctgatcgcggccctgtgtgccacggtgctgctgaagatacgcaacgcccgctatcgcgggctgtgcgaggacgaggagcgcgacgaggaccgggacggcattccggacgtctacgagcaggacgacccggcctaccacctgcggatggcggacatcttcgagcgcaaggccgccgagcaccgccgcatcgccgccgagaaggccgccgcggcgcgccacgggggtgcggaagtgccgggcggggcaggcgaggaggacggtcgtccggcataa

SEQ ID NO: 674 - protein, 480 aa, Streptomyces antibioticus
MAAPRTPNTARKVLGRLSLPERTFVADALRTETVGGVLLLVATVTALVWANIPALQHSYEAVSHFHFGPSALGLNLSVAHWAADGLLAVFFFVAGIELKRELVAGDLRDPRAAVLPVVAALCGMAVPALVYTLTNLTGHGSTQGWAVPTATDIAFALAVLAVIGTSLPSALRAFLLTLAVVDDLFAILIIAIFFTERINFAALGGAVAGLAVFWLLLRKGVRGWYVYVPLAVVVWALMYNSGVHATIAGVAMGLMLRCTTREGEEHSPGEHIEHLVRPLSAGLAVPLFALFSAGVVVSGGALGDVFTEPETLGVVLGLVVGKTLGIFGSTWLTARFTHAELSEDLEWADIFAVASLAGIGFTVSLLIGELAFAGDTLLTDEVKAAVLTGSLIAALCATVLLKIRNARYRGLCEDEERDEDRDGIPDVYEQDDPAYHLRMADIFERKAAEHRRIAAEKAAAARHGGAEVPGGAGEEDGRPA

SEQ ID NO: 675 - DNA, 1185 bp, Gamma proteobacterium Hot 75m4
  CDS (1)..(1185)
atgataaatacaccggatccctccaaacgcgcattgattctgcgcctgcttgagcggttcatacaaacggaatcctccggcggcgtgattatgatcattttcgcggcgctcgccatgattgccgccaattcggcgctcgccggctggtatggcgcgtttgtagatgcgccaatcacgcttggcagcatcaccgagcccgtaaacggctgggtgaaggacgtgctgatggtgctgtttttcctcactgtcggcatggagctgaaacgcgagatggcggaagggttgctggcgcagaaaggccaggtgtttatgccgctgcttgccgccattggcggcatggctgttccggcgttattattctatgcgctcaatcattccaatcccgaaaccgtcaagggctgggctatcccttccgctaccgacatcgcattcgctttatgcatcctgatgatgtttggcaagtccgtgcccgcttccgccaaaatcctgctgcttgccatcgccattttcgacgatctgggcgcgattatcatcatcgccctgttctacaacaccaaaatcgccgtggttcccctgctcttcaccgcaggcggcgctggcctgctggcactgctcaaccgctgcaagatttccgccattacgccctatatcctcaccggaatttatttgtggttctgcctgcatgaagcgggcatccacacaacgattgcaggtgtggctgtcggcatggccatccccatgcgcgaccgcaaacattccagcaacagcccgcttaacaaatgcatgcatttcctgcatccgtgggtgagtttcggcgtgctgcccatttttgccttcgtgagcgccggggttaacttcgcggatatgcatctatcggaattgtttgaaccgcttccccttggcatcgcactcggcctgttcgtgggcaagcagatcggcatattcggcatgattttcctgctggtaaaggcagggctggcgaaactccccgaaggcacgggtttcggccatgtctacgccgtctccatcatcgcaggcatcggcttcacgatgagcctgttcatcagcctgctcgcctttcccggccaccatctgcaggaagtggccaaaatcggcgtgattgcggggtcgctgctttcgacgctttatggtgggttagtgttgttctgcgtgagcaaacgctaa

SEQ ID NO: 676 - protein, 394 aa, Gamma proteobacterium Hot 75m4
MINTPDPSKRALILRLLERFIQTESSGGVIMIIFAALAMIAANSALAGWYGAFVDAPITLGSITEPVNGWVKDVLMVLFFLTVGMELKREMAEGLLAQKGQVFMPLLAAIGGMAVPALLFYALNHSNPETVKGWAIPSATDIAFALCILMMFGKSVPASAKILLLAIAIFDDLGAIIIIALFYNTKIAVVPLLFTAGGAGLLALLNRCKISAITPYILTGIYLWFCLHEAGIHTTIAGVAVGMAIPMRDRKHSSNSPLNKCMHFLHPWVSFGVLPIFAFVSAGVNFADMHLSELFEPLPLGIALGLFVGKQIGIFGMIFLLVKAGLAKLPEGTGFGHVYAVSIIAGIGFTMSLFISLLAFPGHHLQEVAKIGVIAGSLLSTLYGGLVLFCVSKR

SEQ ID NO: 677 - DNA, 441 bp, Rickettsia sibirica
  CDS (1)..(441)
atggtggagccaggtattcacgataccttatgcagagccattatagcactttttatacctgttaatataaaaggagaatttaacacttcttttaaaaaacttgaaaacttaactcgtccttttgtaaattactttattttaccgctttttgtatttatgaattccggtatccttttagaatattttgcatttaaaggcatttgttccaactcaatacttgctttaatttatgggataatatttggtttatttgtaggtaagcaattaggtattatgctattttcatatccatttgtaaaatttaaactctgtaacttaccaagtgatacttcatggttaaaattttattctatagctatacttggagggattagatttaccctaagtttatttataggtagtattttacgtttgagagcagctgcccttcaaactctatga

SEQ ID NO: 678 - protein, 146 aa, Rickettsia sibirica
MVEPGIHDTLCRAIIALFIPVNIKGEFNTSFKKLENLTRPFVNYFILPLFVFMNSGILLEYFAFKGICSNSILALIYGIIFGLFVGKQLGIMLFSYPFVKFKLCNLPSDTSWLKFYSIAILGGIRFTLSLFIGSILRLRAAALQTL

SEQ ID NO: 679 - DNA, 1140 bp, Pasteurella multocida
  CDS (1)..(1140)
atgttaacaccaattcaaaactttctgaaacaagaagcggcaggtggtattctgctgttcatttttgcaaccttagccattattttagccaataccccattaagttatttatactttgattttttgcaaacaccagtgagtgtccaaattggtgcattcatcatcaataaaccgcttttaatgtgggtcaacgatggtcttatggccgtgtttttcatgctcgtcggaatggaagttaaacgtgaattactagaaggctcgttatccagttatcaacgtgctgtttttcccgccattgcggcaacaggcggtatggttgttcctgcaattgtctttcttgtgtttaacgcaacacatcctgaatttcaagagggatgggcgatcccgatggcaacggatatcgcttttgcccttggcgtcatcgccttattaggtaaacgtgttccactcgcgctgaaaattttcttgttggcactggcgattattgatgacttaggggcgattgttgttattgcgctatttttctctcatgatttaagtccacaagcctttatcttcgcggggattgctgtggcaattttgatcacaatgaaccgtttaaaaattactgcactctcggcttacggcattgtcggtattattctttgggcatccgtactcaaatcaggtgtacacgccactttggcgggagtgattatcggtttttgtatcccattaaacggtaagaaaggcgagcgcccactagatgactttgaacatactttatcaccttggagtgcctttgcgattctcccactgtttgctttctgtaatgctggggtttcattaattggtatgggaatggataacttaacctctacgttaccaatggggattgcccttggcttactcttaggtaaacctctggggattttctcattctgttttgtggcagtaaaattaggcattgctaagctgtctgaaggcattaatttcaaacaaatttttgctgtgtctgtactctgtggaattggatttaccatgtccatgttccttgctggtctcgcctttggtggagaaagtgatagcgaaaatgtcactgcactcgcccgtttaggtattctgattggttctggtttctccgcggtgttaggttattaa

SEQ ID NO: 680 - protein, 379 aa, Pasteurella multocida
MLTPIQNFLKQEAAGGILLFIFATLAIILANTPLSYLYFDFLQTPVSVQIGAFIINKPLLMWVNDGLMAVFFMLVGMEVKRELLEGSLSSYQRAVFPAIAATGGMVVPAIVFLVFNATHPEFQEGWAIPMATDIAFALGVIALLGKRVPLALKIFLLALAIIDDLGAIVVIALFFSHDLSPQAFIFAGIAVAILITMNRLKITALSAYGIVGIILWASVLKSGVHATLAGVIIGFCIPLNGKKGERPLDDFEHTLSPWSAFAILPLFAFCNAGVSLIGMGMDNLTSTLPMGIALGLLLGKPLGIFSFCFVAVKLGIAKLSEGINFKQIFAVSVLCGIGFTMSMFLAGLAFGGESDSENVTALARLGILIGSGFSAVLGY

SEQ ID NO: 681 - DNA, 1197 bp, Rhizobium loti Mesorhizobium loti
  CDS (1)..(1197)
atgcaggatttgaagcagcggccggtttccgtctttcgcgaattcctcgacagcgaggcggccggcggtatcatcctgatggtggcggcggcactcgccttgatcgtcgccaactcaccgctcgccgaaacctatttctccgttctccatgcctatctcggcccgctcagcgtctcgcattgggtcaatgacgggctgatggcggtgttcttcctgcttgtcgggctggagatcaagcgcgagatgctggacggccagctgtcgacctggccacgccgcgtcctgcccggcatcgcggcggccggcggcatgctggttccggcgctggtctatgtcttcatcaaccgcaacaattcagccgcactctcgggctgggcgatcccgaccgccaccgacatcgccttcgcgctcggcgtgctgtcgctgctcggcagccgcgtgccggcttcgctgaaagtcttcctgaccgcgctcgccatcatcgacgacctcggcgccgtcatcatcatcgccatcttctatacgagcggcctgtcgctggcctatctcggtgccgccttcgccgtcattgcagcgcttgtcgtgctcaaccgcatgcgggtgatgacgctgctgccctatctcgtgctcggcgccatcctgtgggtgctggttctcaagtcgggcgtccacgccacgcttgccggcgttgcgctggcgctgaccattccgctcgagcgctctgccggggtcggccacgatctcgatcattcgccgctgcaccggctcgagcatggcctgcacaaaatcgtgccctttttcgtcatcccgatcttcggcttcgccaatgccggcgtttcgctcgccggcctcagtcttggcgcgctgatcgagccgctgacgctgggcgtcgccgccggccttgttgtcggcaagctcgtcggcgtgttcggctcttcggcgcttgccataaggctcggcctggccgacctgccggcccataccggctggtcacatatgatcggcatctcgctgctctgcggcatcggcttcaccatgagcctgttcatcggcctgctcgccttcgccagcgatgtggctctgcaggacgcggtcaaggtcggcatcctcgccggctccttcgtcgccgccatactcggcgccgccgtgctgctgatggcgccggctgcgggtgttgcggaagaagagacggagtaa

SEQ ID NO: 682 - protein, 398 aa, Rhizobium loti Mesorhizobium loti
MQDLKQRPVSVFREFLDSEAAGGIILMVAAALALIVANSPLAETYFSVLHAYLGPLSVSHWVNDGLMAVFFLLVGLEIKREMLDGQLSTWPRRVLPGIAAAGGMLVPALVYVFINRNNSAALSGWAIPTATDIAFALGVLSLLGSRVPASLKVFLTALAIIDDLGAVIIIAIFYTSGLSLAYLGAAFAVIAALVVLNRMRVMTLLPYLVLGAILWVLVLKSGVHATLAGVALALTIPLERSAGVGHDLDHSPLHRLEHGLHKIVPFFVIPIFGFANAGVSLAGLSLGALIEPLTLGVAAGLVVGKLVGVFGSSALAIRLGLADLPAHTGWSHMIGISLLCGIGFTMSLFIGLLAFASDVALQDAVKVGILAGSFVAAILGAAVLLMAPAAGVAEEETE

SEQ ID NO: 683 - DNA, 1167 bp, Salmonella typhimurium
  CDS (1)..(1167)
atgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccggcattgctctatctggcctttaactactccgatccggtcactcgcgagggctgggctattcctgccgcgacggatatcgcctttgcgctgggcgtgttggcgctgttgggcagccgggttccgctggcgctgaaaattttcctgatggcgctggcgatcatcgatgatctcggcgccatcgttattatcgcactgttttataccagcgatctttctatcgtctcgctgggcgtggcggcgttcgcgattgccgtgctggcgctgctgaacctgtgcggcgtcagacggactggggtatatattctggtcggggcagtgctgtggacggcggtactgaagtccggcgttcacgcgacgctggcaggcgtcattgtcggtttctttattccgctgaaagaaaaacacggtcgctcgccggcgaagcgtctggagcatgttctgcacccgtgggtcgcgtacctgatcctgccgctcttcgcttttgcgaatgctggcgtttctcttcagggcgtcacgattgacggtctgacctccatgctgccgttgggaattattgccggtctgctgattggtaagccgctggggattagcctgttttgctggctggcgctgcgtttcaagctggcgcatctgccacaggggaccacttatcagcaaatcatggcggtcggcattttgtgtggcattggctttacgatgtccatctttatcgccagcctggcatttggcaatgtcgatccggaacttattaactgggcgaaattgggcattttgattggttcattgctctccgcagtggtggggtatagctggttgcgcgcgcgtttgaacgcgccggcataa

SEQ ID NO: 684 - protein, 388 aa, Salmonella typhimurium
MKHLHRFFSSDASGGIILIIAAALAMLMANMGATSGWYHDFLETPVQLRVGALEINKNMLLWINDALMAVFFLLIGLEVKRELMQGSLASLRQAAFPVIAAIGGMIVPALLYLAFNYSDPVTREGWAIPAATDIAFALGVLALLGSRVPLALKIFLMALAIIDDLGAIVIIALFYTSDLSIVSLGVAAFAIAVLALLNLCGVRRTGVYILVGAVLWTAVLKSGVHATLAGVIVGFFIPLKEKHGRSPAKRLEHVLHPWVAYLILPLFAFANAGVSLQGVTIDGLTSMLPLGIIAGLLIGKPLGISLFCWLALRFKLAHLPQGTTYQQIMAVGILCGIGFTMSIFIASLAFGNVDPELINWAKLGILIGSLLSAVVGYSWLRARLNAPA

SEQ ID NO: 685 - DNA, 1419 bp, Bifidobacterium longum
  CDS (1)..(1419)
atggccacgaccgccggcgcgaagaagggactttggtccaccatcaggcgaatcgccgcctcagaccgtatttccggactcatcatgcttggcttcgcgctcaccggcctggtgctcgcgaatctgcccgccaccgcgcatgcgttcgagaccgtagcggaaacgcatctgttcatcccctacaccaatctcgacctgcctattggccactgggcccaggatggtctgcttaccatcttcttcctgaccgtgggcctcgaactgaagcaggaactcaccaccggctcgcttgccaatccgaaagcggccgccgtgccgatgctgtgcgcggtgggcggcatgatcgccccgcccatcctgttcctggccgtcacggcattgttctctcagatcgggcctggtgaacccggcacgctgattctgaccaccaccggcagcagcatcccgttctcggagatgtcgcacggctgggcagtgcccaccgccacggatatcgcgttctcgctggccgtgctcgccctgttcgccaaggccctgcccggttcgatccgcgcgttcctgatgacgcttgccaccgtcgacgacctgctggccattattctgatcgccgtattcttctcctcgattaacgcctggtattggttcatcggcatcgccgtatgcgccgccatctgggcatacctcgtacgactgaaaaaagtgccgtggatcgcggttggcatcgtcggtatcctcgcttggatcatgatgttcgaggcaggcgtgcaccccacactggccggcgtgctggttggcctgctgaccccctctcgtgaaatgcacggcgaactctcgccgcgtgccgaacgctatgccaacaagctccagccattctccgcactgctggccctgcccatcttcgccttgttcgccaccggcgtacacttcgagtcgatgagcccgctattgttggcctcgccgctggtcatcgcactgattgtggctttggtggtcggcaaacctctgggtatcatcaccaccgcatggctgtccacgcatgtgggcgggctcaagatggccaaggggctgcgtgtgcgcgacatgattcctgctgccgtcgcttgcggcattggcttcactgtgtccttcctcatcgcttcgctggcgtacaagaacgcggaactttccgctgaggcgcgcttcggcgtgctggtggcctccctgatcgccgccgcgatttccggtgtgctgctgagccgtcagtccaagcgattcgagaagaccgcagccgcagcagcggctgatgaggaggatgacgaatcgattgatggtgatggcatcgggcagccaagccacaccacagagcccaccacgcccacggaacaccccggcaccctcgccgacggcaccgccagtgtggaaatcgacttccgccactaa

SEQ ID NO: 686 - protein, 472 aa, Bifidobacterium longum
MATTAGAKKGLWSTIRRIAASDRISGLIMLGFALTGLVLANLPATAHAFETVAETHLFIPYTNLDLPIGHWAQDGLLTIFFLTVGLELKQELTTGSLANPKAAAVPMLCAVGGMIAPPILFLAVTALFSQIGPGEPGTLILTTTGSSIPFSEMSHGWAVPTATDIAFSLAVLALFAKALPGSIRAFLMTLATVDDLLAIILIAVFFSSINAWYWFIGIAVCAAIWAYLVRLKKVPWIAVGIVGILAWIMMFEAGVHPTLAGVLVGLLTPSREMHGELSPRAERYANKLQPFSALLALPIFALFATGVHFESMSPLLLASPLVIALIVALVVGKPLGIITTAWLSTHVGGLKMAKGLRVRDMIPAAVACGIGFTVSFLIASLAYKNAELSAEARFGVLVASLIAAAISGVLLSRQSKRFEKTAAAAAADEEDDESIDGDGIGQPSHTTEPTTPTEHPGTLADGTASVEIDFRH

SEQ ID NO: 687 - DNA, 1182 bp, Brucella suis
  CDS (1)..(1182)
atgaatcatagcccgcaatccgctcgccccgtttccatcatgcgacgttttctggacagcgaagccgctggcggcataacgctcatggctgcagcggcgcttgccctcatcgttgcaaattcgccctttgcccagacctatttcgatgcgttgcatctatatatcggcccgctcagccttgcgcactggatcaacgatgcgctgatggcaatattctttttgctggtgggactggaaatcaagcgcgagatgctggacgggcagctcgcaagctggcccaaccgcatgttgccgggcattgcggcagcgggcggcgtcattttgcctgcaatcattttcgcggttctcaaccatgacaatccggccaagctgcgcggctgggcggtgccatcggcaaccgatatcgcctttgcgctcggcgtactgtcgcttctgggttcgcgcgcgccgtcaagcctcaaggtgtttctggcaacgcttgccattcttgacgaccttgccgccgtggtcatcatcgcaatcttctacacggctgaaatttccatgccctatctgggcgcggcctttatcaccgccgcggtcctctttgtcatgaaccgcatgggcgtggtgaagctcctgccttatctgatcagcgctgtgatcctctggttcttcgtcttcaattccggcgttcatgccacggttgccggtgttgtcgcagccctcatgatcccgctaaaacctgcacccggcagacccgacgacatgacctcgcccctgcacaagctggaacatgcactggccaagcccgttgccttcatcgtcgtgccgatcttcggctttgccaatgcgggcatttccttcaaggggcttgaggcttccgtcctgggcgacacgctgacactcggcatcctgctcggccttttcctcggcaagcagttcggcgtcttcggcgcggcctggctcgccatcaaaacggggcttgccgaaaagccgatgggcgcaagctgggttcagctttacggcgtcgccattctttgcggcatcggctttacgatgagcatcttcatcggccttctctccttcccgtccgacctcatgcagacggaaacgaagatcggtgtcctttccggctccgccctttcggccatttgcggctatctcctgttgcgggcggcggccagaccaaagcgcggctaa

SEQ ID NO: 688 - protein, 393 aa, Brucella suis
MNHSPQSARPVSIMRRFLDSEAAGGITLMAAAALALIVANSPFAQTYFDALHLYIGPLSLAHWINDALMAIFFLLVGLEIKREMLDGQLASWPNRMLPGIAAAGGVILPAIIFAVLNHDNPAKLRGWAVPSATDIAFALGVLSLLGSRAPSSLKVFLATLAILDDLAAVVIIAIFYTAEISMPYLGAAFITAAVLFVMNRMGVVKLLPYLISAVILWFFVFNSGVHATVAGVVAALMIPLKPAPGRPDDMTSPLHKLEHALAKPVAFIVVPIFGFANAGISFKGLEASVLGDTLTLGILLGLFLGKQFGVFGAAWLAIKTGLAEKPMGASWVQLYGVAILCGIGFTMSIFIGLLSFPSDLMQTETKIGVLSGSALSAICGYLLLRAAARPKRG

SEQ ID NO: 689 - DNA, 1167 bp, Escherichia coli O6
  CDS (1)..(1167)
atgaaacatctgcatcgattctttagcagtgatgcctcgggaggcattattctcattattgccgctgtattagcgatgattatggccaacagcggtgcaaccagtggatggtatcacgactttcttgagacgccggttcagctccgggttgggacacttgagatcaacaagaacatgctgctatggatcaatgacgctctgatggcggtatttttcctgttggttggtctggaagttaaacgcgagctgatgcaaggttcgctggccagtctgcgccaggcggcatttcctgttattgccgcaatcggcgggatgattgtcccggcattgctctatctggcttttaactatgccgatccgattacccgcgaaggctgggcaatcccggcggcgactgacattgcctttgcacttggtgtgttggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgtggtattgaatctgtgtggtgtacgccgcacgggcgtttatattctggttggcgtggtgctgtggacagcggtgttgaaatcgggggttcacgcaaccctggctggcgtcattgtcggcttctttattcctttgaaagagaagcatgggcgctctccggctaaacgtctggagcatgttttgcatccatgggtggcgtatctgattttgccgctgtttgcatttgctaatgctggcgtttcactgcaaggtgtcacgctggaaggtttgacctccatcctgccattagggatcatcgctggtttgctgattggcaagccactgggtattagtctgttctgctggttggcgctgcgtttgaaattggcacatctgccagagggaacgacttaccagcaaattatggcggttggtatcctgtgcggtatcggttttactatgtctatctttattgccagcctggcatttggtagcgtagatccagaactgattaactgggcaaaattaggtatccttgtcggttcaatttcttcggcggtaattggatatagctggttacgcgttcgtttacgtccatcagtttaa

SEQ ID NO: 690 - protein, 388 aa, Escherichia coli O6
MKHLHRFFSSDASGGIILIIAAVLAMIMANSGATSGWYHDFLETPVQLRVGTLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLVVLNLCGVRRTGVYILVGVVLWTAVLKSGVHATLAGVIVGFFIPLKEKHGRSPAKRLEHVLHPWVAYLILPLFAFANAGVSLQGVTLEGLTSILPLGIIAGLLIGKPLGISLFCWLALRLKLAHLPEGTTYQQIMAVGILCGIGFTMSIFIASLAFGSVDPELINWAKLGILVGSISSAVIGYSWLRVRLRPSV

SEQ ID NO: 691 - DNA, 1170 bp, Shewanella oneidensis
  CDS (1)..(1170)
atggaaaaagcaattagaaattttttgagccaagagtcggcaggtggcatcctcttattaattgccgtggcctttgccatgttaatggcgaattctcctctggctggattctatcaaggttttctcggtactgaagttcaagtacgagttggcgcgctcgatctgcataagccattgttgttgtggattaacgatggtttgatggcattgtttttcttgctgattggtttagaagttaaacgtgagctattggaaggggcactatcgagtgtggctcaggcctcattgccaaccttcgcagccattggtggcatgttagtgccagcgggtatttacctgttatttaactatggcgatcctatcacacaagcaggttgggcaatcccagctgcgacagatattgcttttgctttggggatcatggctttactgggtagccgcgtgcctgtggcgttaaaggttttcctgctggcgttagccatcattgacgatttaggcgttattgtgattatcgcgcttttctacagcagtgatctatcaaccgttagcttaattattgccagcattgcgattgttggtttggttgccttaaaccgcaagggcgtgacctcattagccccttatggagtactcggactaattctgtgggtggctgtacttaagtctggtgtgcatgccacattagcgggtgtcattattgctttctgtattcctctgcgagcaaaagatggcagttcgccttctgagcatttagagcatagtttgcatccttggagcactttcctgatcctgccagtgttcgccttcgccaatgctggggtcgctttaggaaacatgagtttagatacgctaatgtcccctgtaccagtggggattgcattgggactcatgctaggtaagccgattggtgtgatgttgtttagttttgtcgccgtcaaacttaagttagcacaattgcctgatggtattggttggaaacaaattgcgccagtggcagcgatgtgtggtatcggttttaccatgtcaatgtttattgcttcgttggcatttgagcaggcagaccctatgtttggtgatttagcacgcctaggcaccttaatgggctcaatttttgcggccttaatcgggtatttctggttatcaaaagtgttacctaaaaaaggagtataa

SEQ ID NO: 692 - protein, 389 aa, Shewanella oneidensis
MEKAIRNFLSQESAGGILLLIAVAFAMLMANSPLAGFYQGFLGTEVQVRVGALDLHKPLLLWINDGLMALFFLLIGLEVKRELLEGALSSVAQASLPTFAAIGGMLVPAGIYLLFNYGDPITQAGWAIPAATDIAFALGIMALLGSRVPVALKVFLLALAIIDDLGVIVIIALFYSSDLSTVSLIIASIAIVGLVALNRKGVTSLAPYGVLGLILWVAVLKSGVHATLAGVIIAFCIPLRAKDGSSPSEHLEHSLHPWSTFLILPVFAFANAGVALGNMSLDTLMSPVPVGIALGLMLGKPIGVMLFSFVAVKLKLAQLPDGIGWKQIAPVAAMCGIGFTMSMFIASLAFEQADPMFGDLARLGTLMGSIFAALIGYFWLSKVLPKKGV

SEQ ID NO: 693 - DNA, 1170 bp, Vibrio vulnificus
  CDS (1)..(1170)
atgaacgatgtcattcgtgactttttcaaaatggaatctgctggtggcattttgcttgtgatcgctgccgccatcgcaatggtgattgcaaactcgcctctcaatgaaagttaccaagcggttttgcatacttatgtatttggcatgtcagtatctcactggatcaatgatggcctaatggcaattttcttcttgctgatcggcttggaagttaagcgtgaattattagaaggcgcattgaaatcgcgtgaaactgcgatcttcccagcgattgccgcagtgggtggtatgttggcgccagcgcttatctatgttgctttcaatggaaacgatccggaagcgattaaaggttgggcaattccagcagcgaccgatattgcatttgctttgggtatcatggcgctgctaggtaagcgcgttcctgtcagtcttaaagtgttccttttggcattagcgatcatcgatgacttgggcgtcgttgtgattattgcgctcttctacagtggcgatttgtcgacacttgcgttgacggttggattcgcgatgacgggtgtcttgttcatgctaaacgctaagaatgtgactaagttaatttggtatatcgttgtcggctttatcttgtgggttgcggtactgaaatccggagtccatgcaaccttggcaggtgtcgtgattggtttctctatcccattacagggtaaaaaaggtgagcactctccgttgaaacacatggaacatgcgcttcacccatatgttgcctttgctatcttacctgtctttgcctttgctaacgctggtatctcgcttgaaggggtgtctctttctggcttgacttccatgttgccgctgggtatcgcgctaggactgttggttggtaaaccactgggtatctttacgtttagctgggcagcggtgaagtttggtgtggctaaattgcctgaaggtgtgaacttcaagcatatctttgccgtgtcagtgctctgtggtatcggtttcaccatgtcgatctttatttcatcgctggctttcggtggtgcaaatccagacttcgatacttattcacgactaggtatcttaatgggatcgacgacagcggcagtgcttggttatttcttactgcatgtatcgctgccaaagacagcggcggaaagtgagaaagcaatcagctaa

SEQ ID NO: 694 - protein, 389 aa, Vibrio vulnificus
MNDVIRDFFKMESAGGILLVIAAAIAMVIANSPLNESYQAVLHTYVFGMSVSHWINDGLMAIFFLLIGLEVKRELLEGALKSRETAIFPAIAAVGGMLAPALIYVAFNGNDPEAIKGWAIPAATDIAFALGIMALLGKRVPVSLKVFLLALAIIDDLGVVVIIALFYSGDLSTLALTVGFAMTGVLFMLNAKNVTKLIWYIVVGFILWVAVLKSGVHATLAGVVIGFSIPLQGKKGEHSPLKHMEHALHPYVAFAILPVFAFANAGISLEGVSLSGLTSMLPLGIALGLLVGKPLGIFTFSWAAVKFGVAKLPEGVNFKHIFAVSVLCGIGFTMSIFISSLAFGGANPDFDTYSRLGILMGSTTAAVLGYFLLHVSLPKTAAESEKAIS

SEQ ID NO: 695 - DNA, 1344 bp, Vibrio vulnificus
  CDS (1)..(1344)
atgactaaaagaaagaagagagcagccattaatctgacccggctaccaatagagtacattgattggttatctcgtcctatataccgttttattcatattgaatctgccgctggaattgtactgtttatttcaacgctcttagctgttttattggctaattcacatttaagtgaggagtttgctcgtttttggcagatttcgctagggatgacggttggtgatttagtttttgagcgttcattacacaaatgggtcaatgatgccggaatgaccctatttttctttcttattgccttggagcttaagcgtgagttagtgctaggtgaacttcgcaatccccaattagctctcctttccattgctgctgctcttggaggcatgtcgaccccgcctcttttttacttacttctacagtacggtgaatccggtcagcatggttgggggacggtcatggcaacggataccgcctttgtgatcggatgtcttgcactcttagggcgaagcattccaagcagtttgcggatattcatgttatcaatggccgtggtggatgatatcggtgcgatctttgttgtcgctattggttacggagaagcggttgactggctggtgttatcctatgcgttgttgggctttatgcttgtccgtgcgatggctttcttaggggtccgtagtcttgtactcttttctattgtcggcggagcaatatggttggttatcgatatgtctggtgttcatccaacaattacaggagtgattctcggcttactaacccccacgaataaatggatgagtaggcagcatctttttatcattatggaggctttagtgccatcttcacctagtcaacaatggagtggtgacaagagagaaggagagatcttaaaaaccgcagcggcggctgcacgagaaacgctttcacctgtagagcggctggaaatgttgcttcatccttgggtcgggtttgttgttttaccgttgtttgctcttgctaacgcgggagtttcattgaccagtgtaaacctaacgtctcctattacgctggctgtttttgtgggttttgtttttggtaaacctatcggtattgtcttgtttagttggattgctgtctggctagggatcgcgaaattgcctgaaaatttgaattggggaatggtatttgggggaggtatgttggctggtattggttttactatggcactattcatctcggaactagcgtataacccagaccaaataaatgctgcgaaattgggtatcttcatcgcgtccattacttcggctttaattggtttcctctgtttacggtatttcgcggctagagaaaaacagaagaggacttaa

SEQ ID NO: 696 - protein, 447 aa, Vibrio vulnificus
MTKRKKRAAINLTRLPIEYIDWLSRPIYRFIHIESAAGIVLFISTLLAVLLANSHLSEEFARFWQISLGMTVGDLVFERSLHKWVNDAGMTLFFFLIALELKRELVLGELRNPQLALLSIAAALGGMSTPPLFYLLLQYGESGQHGWGTVMATDTAFVIGCLALLGRSIPSSLRIFMLSMAVVDDIGAIFVVAIGYGEAVDWLVLSYALLGFMLVRAMAFLGVRSLVLFSIVGGAIWLVIDMSGVHPTITGVILGLLTPTNKWMSRQHLFIIMEALVPSSPSQQWSGDKREGEILKTAAAAARETLSPVERLEMLLHPWVGFVVLPLFALANAGVSLTSVNLTSPITLAVFVGFVFGKPIGIVLFSWIAVWLGIAKLPENLNWGMVFGGGMLAGIGFTMALFISELAYNPDQINAAKLGIFIASITSALIGFLCLRYFAAREKQKRT

SEQ ID NO: 697 - DNA, 1191 bp, Wigglesworthia glossinidia brevipalpis
  CDS (1)..(1191)
atgaaaaaattttttatttgtaaatcaaaattttttaaaaatccaacttttagtggattattattaattttattttgttttttagctatatttataagtaatacaaatttctggaaaacatataattacatcataaattatcctttaattaaaattaatacgcacgataaaaatttttcattaactaacattgttaatgatattttgatgacatttttttttctagaaataggtattgagatcaagcacgagatgttagtaggatcgttaaaaaataaatctagagcaattttgccaggaatagctgcaataggaggaatgattttccctgcattaatatataattttataacgaaagaagatagctctatctcttcaggatgggcaattacagtagctactgatatagcttttgccgttggcgttttaaaaattttaggacattctattcctcacagtttgctaattttccttctttctttagctatttttgatgatataggagcaatattaattattgcgtttttctatagcaatcatattgatcaatatatgatattgttatctacattagttatattaacaatattatcaattaattatttaagagtaacttgtatatatatatatattatttttggaatattattatgggaatcaatattcctatcaggaatacattctactatatctggagttatattaggaatattgatgcctcactcttcttatttatccagtagtaaatatgaaaaatcgatggcttttcttaagaagagtttaagttttttaaacaaatattttattttacctatttttgctttttttaattctggaattaatttttccaattttgaaaatctttcctcttcacttttgccttttggcattttttttggattagttcttggaaagcctattggagtatttctattttcttatttatcagtaaaatttaaattgtctaaattaccagttggaatttcttttaaagaaattgcaggaatttcatttttatgcggcatagggtttactatgtctatttttatttctaatttagcttttcaaaatattaatgaaaaaattatatatattgcaaaatttagtatattaatttcatctatagtatctagcgtaattggatttttgtttttatattttttatataaaaaaattaaattaaaaaattaa

SEQ ID NO: 698 - protein, 396 aa, Wigglesworthia glossinidia brevipalpis
MKKFFICKSKFFKNPTFSGLLLILFCFLAIFISNTNFWKTYNYIINYPLIKINTHDKNFSLTNIVNDILMTFFFLEIGIEIKHEMLVGSLKNKSRAILPGIAAIGGMIFPALIYNFITKEDSSISSGWAITVATDIAFAVGVLKILGHSIPHSLLIFLLSLAIFDDIGAILIIAFFYSNHIDQYMILLSTLVILTILSINYLRVTCIYIYIIFGILLWESIFLSGIHSTISGVILGILMPHSSYLSSSKYEKSMAFLKKSLSFLNKYFILPIFAFFNSGINFSNFENLSSSLLPFGIFFGLVLGKPIGVFLFSYLSVKFKLSKLPVGISFKEIAGISFLCGIGFTMSIFISNLAFQNINEKIIYIAKFSILISSIVSSVIGFLFLYFLYKKIKLKN

SEQ ID NO: 699 - DNA, 1320 bp, Bacteroides thetaiotaomicron
  CDS (1)..(1320)
atgacaattttgcgtacaatgcgaaatttctcgtcaatgaatattgcggcgagtatccttttgtttgtagcggcaatagcggctgctatcatagccaattctccggttgctccggtttatcaggagttccttttgcatgaacttcatttgcagatcggtaattttaatctgctttcgcatggcggagagaatctgcggatgatcgagttcatcaatgacgggttgatgaccatctttttcttgctggtaggattggaaatcaaacgggagttgttggttggtgagctttcttccttccgcaaggcggcgcttccctttattgctgcctgtggcggtatgctgtttccggtgattgtttacatgtcaatctgtcctccgggcagtgcgggaagtcagggattggccattccaatggcaacggatattgctttttcgttaggggtattaagtctgttgggaagccgtgtgccgttgagcctgaagatatttctgacggcttttgcggtagttgatgatatcggaggtatccttgtaattgctcttttttatagttcgcatgtgtcgtatgggtatattttgatagccgcattgctttacgttttactttattttatagggaagcgtgggactaccaataagattttctttttagtgatcggtgtcgttatatggtatttatttttgcaatccggtattcatagtaccatttcgggagttattctggcgtttgttattccggcgaaaccccgtctagatgttggaaaatatatcgagcatattcgtcatacaattgcaggtttcccggtggtggaatcgggaagtatcgtattgactaatgagcagattgccaaactgaaagaggtcgaatctgcttccgaccgtgttatcagtcctctgcagtctttggaggataatttgcatggagctgtcaattatctgattcttccgttgtttgcctttgtcaatgcaggcgttgtctttagtggcggcggtgagttggtgggaagtgtagggatggcagtggcagcagggttgctgtttggtaaatttgcgggaatttatttctttacctggttggctataaagataaaacttactccaatgccgccgggcatgacttggaagaatctttccggtatagctctgttgggagggatcggttttacggtgtcgcttttcattgccaatctttcttttggtgcaaactaccctgttctgttgaatcaggctaagttcggagtgctatcggggactattctttccggattattaggatacattgtactcaggatagtattacctgtccgaaagcggaaataa

SEQ ID NO: 700 - protein, 439 aa, Bacteroides thetaiotaomicron
MTILRTMRNFSSMNIAASILLFVAAIAAAIIANSPVAPVYQEFLLHELHLQIGNFNLLSHGGENLRMIEFINDGLMTIFFLLVGLEIKRELLVGELSSFRKAALPFIAACGGMLFPVIVYMSICPPGSAGSQGLAIPMATDIAFSLGVLSLLGSRVPLSLKIFLTAFAVVDDIGGILVIALFYSSHVSYGYILIAALLYVLLYFIGKRGTTNKIFFLVIGVVIWYLFLQSGIHSTISGVILAFVIPAKPRLDVGKYIEHIRHTIAGFPVVESGSIVLTNEQIAKLKEVESASDRVISPLQSLEDNLHGAVNYLILPLFAFVNAGVVFSGGGELVGSVGMAVAAGLLFGKFAGIYFFTWLAIKIKLTPMPPGMTWKNLSGIALLGGIGFTVSLFIANLSFGANYPVLLNQAKFGVLSGTILSGLLGYIVLRIVLPVRKRK

SEQ ID NO: 701 - DNA, 1194 bp, Pseudomonas putida strain KT2440
  CDS (1)..(1194)
atggagggcctacagcccgtgcgtagcctgtttacccgtttcttccagctcgaagccgccagtggcctgctgttgatcgccgccgccgttctggccctgatcatcaacaactcgccactgtcctacctgtacggcggcttgctcgaggtacccgtcgccgtccaggtcggcgcgctgaacatcgccaagccattgctactgtggatcaacgacggcctgatggccctgttcttcctgctcatcggcctggaggtcaaacgcgaggtggtcgacggtcacctgtccaagccctcacaagtgattctgcctgccaccgcagccgtgggcggcatggtggtgccagcgctgatctactggttcatcaaccgtgacaaccctgcagccgtggcaggctgggcgatccctaccgccaccgacatcgccttcgccctcggcgtcctggccctgctcggcaagcgcgtaccagtgtcactgaagttgttcctgatgaccctggcgatcatcgacgacctgggtgcgatcattgtcatcgccctgttctactccggcaccctgtcgagtgtgtcgctgctgctggctgcggcctgtctgctggtgctggtggcgatgaaccggcttggcgtgatcaagcttggcccctacatgatcgttggcctgatcctgtgggtttgtgtgctcaagagtggcgtgcatgccaccttggccggtgtcgcgctggccttttgcatcccgctgcgtacacgcaatgctgaatcgtcgccgctgctggcgctggaacatgccctgcacccctgggtggcctatgccatcctgccaattttcgcctttgccaatgccggcgtttcgctggcaggcatgaccgtagacagcttcacccaccccgtgccgatgggcatcacgatcggcctgttgctgggcaagaccgtgggggttttcggcctgacctgggtggcggtcaagctgcgcctagccgcgctgcctgcgggcgctggttgggggcaaattctgggggtggcgatactctgcggcattggctttaccatgagcctgttcgtaggctcgctcgccttcgccccgggtagcagtgagtacgccggcatggaccgcatgggcattcttactggttcgttctttgctgcggtgatcggctacgccgtcaccgcaatggccagccgcaaaaccagcattgcctaa

SEQ ID NO: 702 - protein, 397 aa, Pseudomonas putida strain KT2440
MEGLQPVRSLFTRFFQLEAASGLLLIAAAVLALIINNSPLSYLYGGLLEVPVAVQVGALNIAKPLLLWINDGLMALFFLLIGLEVKREVVDGHLSKPSQVILPATAAVGGMVVPALIYWFINRDNPAAVAGWAIPTATDIAFALGVLALLGKRVPVSLKLFLMTLAIIDDLGAIIVIALFYSGTLSSVSLLLAAACLLVLVAMNRLGVIKLGPYMIVGLILWVCVLKSGVHATLAGVALAFCIPLRTRNAESSPLLALEHALHPWVAYAILPIFAFANAGVSLAGMTVDSFTHPVPMGITIGLLLGKTVGVFGLTWVAVKLRLAALPAGAGWGQILGVAILCGIGFTMSLFVGSLAFAPGSSEYAGMDRMGILTGSFFAAVIGYAVTAMASRKTSIA

SEQ ID NO: 703 - DNA, 1362 bp, Pseudomonas putida strain KT2440
  CDS (1)..(1362)
atgcataaacaagaattacctcgcgcccagaaactggccgagcgcgccttcgccaaccttgaacgctttttgcacattgaagcggtcagcggcatcgttctgttgattgccgcagtcgctgccctgatctgggcgaattccccggctgccgacagttatgaagccctttggcataccccgttgacgttcggcgtgggctcgcatgtctattcgcagtccctgcatttctggatcaatgatggcctgatgaccatctttttcctggtcgtgggcatggagatccgccgcgagatccacgaaggtgcactgtccagcctgcgtcaagccacgcttcccatggcagccgctgtcggcggcgtagcggtacccgcactcctctacctgagttttggtcacgcgccagcagaccaacaaggttgggccgtgccaacggcgacggatatcgcctttgcggtgggcgtattggccctgctcggcaagtcgatcccgtccaacgtacgtgtattcctcctcgccctggcaatcatcgatgacatcatcgcagtcctgatcatcgcgttcttctactcaggcggccttgattacaccggcttcggcgttgcagtgatcggcctgctaatggtgatcgggcttcagaagatcggagtgggttcagcctacgcctatgtcattcccggtgcgatcgtctggctgggcatcttgttgaccggcgcccacccgaccctcgcaggcgtcgtgctgggcctgatgacacctgtcaccgcaatgccgatgcgtgagcgcccactggacgccattacccgcttcaccggcgaattgctggggcgcgccaaagcgcctgagcaagatgccagcgacctcatggacccgttgaaacgactgcgcctggcccagcgcgaactgctgccgccggtagtgcgcatgcaaggcaccctgcacccctgggtagccttcggcatcatgccggtgtttgccttggccaacgccggggtcagcctttcgggcgtcgacctgtccgcagaaggcccccagtgggtcatgatcgccgtcgctgtcgccctggttgcaggaaagcccttgggcatcgtcagcgtcagttggctgatggtccgcctgggctggtgcgtgcttcccgccgaggtcaactggcgtagcatcatgctggtcgggctgctggccggcatcggtttcaccatgtcgatcttcatcgccaacctcgcgttcgtcgaccctggctcacttggggccgcgaaactcggtgtgctatccgcgtcgttgatcgcagccgtgctggggttgacctggggggtgtggagcatgcgcagcgcagcgtctgctaccaaagccggttcgcccacctaa

SEQ ID NO: 704 - protein, 453 aa, Pseudomonas putida strain KT2440
MHKQELPRAQKLAERAFANLERFLHIEAVSGIVLLIAAVAALIWANSPAADSYEALWHTPLTFGVGSHVYSQSLHFWINDGLMTIFFLVVGMEIRREIHEGALSSLRQATLPMAAAVGGVAVPALLYLSFGHAPADQQGWAVPTATDIAFAVGVLALLGKSIPSNVRVFLLALAIIDDIIAVLIIAFFYSGGLDYTGFGVAVIGLLMVIGLQKIGVGSAYAYVIPGAIVWLGILLTGAHPTLAGVVLGLMTPVTAMPMRERPLDAITRFTGELLGRAKAPEQDASDLMDPLKRLRLAQRELLPPVVRMQGTLHPWVAFGIMPVFALANAGVSLSGVDLSAEGPQWVMIAVAVALVAGKPLGIVSVSWLMVRLGWCVLPAEVNWRSIMLVGLLAGIGFTMSIFIANLAFVDPGSLGAAKLGVLSASLIAAVLGLTWGVWSMRSAASATKAGSPT

SEQ ID NO: 705 - DNA, 1179 bp, Pseudomonas syringae pv tomato
  CDS (1)..(1179)
atgcacaaccccaccccccgtaccgaatccccgaacgcgctggcgttcatcaagcgctttttcgccgccgaagccgctggcggtctgattttgatggcggctgcactggctgccctgatcgtcgccaattcgccgttggctgacagctattttgcagcgctgcacaccgtgctcgccggcatgtcggtagagcactggatcaacgacggcctgatggcaatcttcttcatgctggtgggccttgagatcaaacgcgaaatgctggcaggccagcttgcgtcctggagtcagcgcgccttgccgggctttgcggcgctgggtggcatggtggtgccggcgttgatctacgtggcattcaactggggccagccagaaaccatcggcggttgggccatcccggctgcgaccgacatcgcctttgccctgggtgtgctttctctgctcggcaaacgcgtaccgttgtccctgaaaatcttcctgtcggcattggcgattctcgatgacctcggcgcggtattgatcatcgcgctgttctacaccagtgatctgtccatccccatgctgctggcggcgctgggctccatcgccgtactcgtggcgctgaaccgtctgggcgttaaaaagctgttgccgtacctgctcatcggcgcgctgctatggtttttcatgctccagtccggcattcacgccacccttgcaggtgtggccctggcgctgtgcattccgctcggcaaagctgatgaagaagccagctcgccactgcttcatctggaagagaaactgcacccgtgggtcgcttttgctgtggtaccgatcttcgggttcgccaatgcgggcgtgtcgctggccggtatcaccgtcgacaaactggtagacccggtgccgctgggcgtcgcgctggggttgttgatcggcaaacaggtcggcatcttcgcccttgcggcactggccatccgcgccggcctggcacgcttgcctgacggcagtaattggggtcagctttacggcgtcgcggcactgtgcgggatcggtttcaccatgagcctgttcatcggcgcactggccttcccgggcgcgccggcactggtggacgaggtcaaggtgggcgtgttgatcgggtcggtgttttcggcgttgttgggggtggtggtgttgcgcaggtttggggcgcgggggtaa

SEQ ID NO: 706 - protein, 392 aa, Pseudomonas syringae pv tomato
MHNPTPRTESPNALAFIKRFFAAEAAGGLILMAAALAALIVANSPLADSYFAALHTVLAGMSVEHWINDGLMAIFFMLVGLEIKREMLAGQLASWSQRALPGFAALGGMVVPALIYVAFNWGQPETIGGWAIPAATDIAFALGVLSLLGKRVPLSLKIFLSALAILDDLGAVLIIALFYTSDLSIPMLLAALGSIAVLVALNRLGVKKLLPYLLIGALLWFFMLQSGIHATLAGVALALCIPLGKADEEASSPLLHLEEKLHPWVAFAVVPIFGFANAGVSLAGITVDKLVDPVPLGVALGLLIGKQVGIFALAALAIRAGLARLPDGSNWGQLYGVAALCGIGFTMSLFIGALAFPGAPALVDEVKVGVLIGSVFSALLGVVVLRRFGARG

SEQ ID NO: 707 - DNA, 1176 bp, Pseudomonas syringae pv tomato
  CDS (1)..(1176)
atgactcaagtcccaaaccgggaaacgccccgtggcgttgccattcttacccgttttctcgcctccgaatcagcgggcggcatcgtgctgatggccgcagcgctggccgcactgatcgtcgccaactcgcccttgtccgcgggctacttctcgacgctgcacagcgtctggctggggctgtcggtcgagttgtggatcaacgacgggctgatggcgatcttctttctgatggtcggtttggagatcaagcgcgaagtgctggccggtggcctggcaacctgggggcaacgcgccctgcccggctttgcagcccttggcggcatgctggtgcccgcgctgatctacatcgcgatcaactggggcaacccgcagaccctgagcggctgggcgatcccggcggccaccgacatcgccttcgccctcggcgtgctgtcgctgctgggcaatcgcgtgccgacctcgctaaaagtcttcctcgccgcgctggcgattctcgatgacctgggggctgtgaccatcatcgcgtttttctacagctccgggcttaatctgccgatgctggccgccgcgttcgtgaccctcgccgtgttggtcgcgctgaaccgcctgaacatccgtcgtctgctgccgtatttgctgctcggtgcgctgctgtggttcttcgtcctgcagtcgggcgtgcacgcgacgctggccggtgtcgcgctggcgctgtgtatcccgatgggcaagcccgaggaagaagcacgctcgccgctgctgttgctggaagaaaaaatgcattactgggtcgcgtttgccgtggtaccgatctttggctttgccaatgccggcgtatcgctttccggcattaccctggcaaacctgatcgacccggtgccgctgggcgttgcattgggcctgtttgtgggcaagcagatcggcgtgtttctcgccgcagtgctggccatccgcgcagggctcgccgtgctgccggagggcagcaactgggtgcagctgtacggcgtggcgatcctgtgtggcatcggcttcaccatgagcctgttcatcggcaacctggcattccccggctcgcagcacctgatcgacgaagtcaaagtcggtgtgctgatcggctcggggcttgcggcggttgccggcatagtgctgctgcgcagccgtttcagccggcactaa

SEQ ID NO: 708 - protein, 391 aa, Pseudomonas syringae pv tomato
MTQVPNRETPRGVAILTRFLASESAGGIVLMAAALAALIVANSPLSAGYFSTLHSVWLGLSVELWINDGLMAIFFLMVGLEIKREVLAGGLATWGQRALPGFAALGGMLVPALIYIAINWGNPQTLSGWAIPAATDIAFALGVLSLLGNRVPTSLKVFLAALAILDDLGAVTIIAFFYSSGLNLPMLAAAFVTLAVLVALNRLNIRRLLPYLLLGALLWFFVLQSGVHATLAGVALALCIPMGKPEEEARSPLLLLEEKMHYWVAFAVVPIFGFANAGVSLSGITLANLIDPVPLGVALGLFVGKQIGVFLAAVLAIRAGLAVLPEGSNWVQLYGVAILCGIGFTMSLFIGNLAFPGSQHLIDEVKVGVLIGSGLAAVAGIVLLRSRFSRH

SEQ ID NO: 709 - DNA, 1158 bp, Tropheryma whipplei strain Twist Whipple s bacillus
  CDS (1)..(1158)
atgagcattattagatctgagcgatattcggcaatttttcttctttgctcggcagcgctagcaattatatttgctaatgttcttgacccggacacatggcatgccgtgcacagcgctgtaagcgaataccacatctttggactgataaccccccatgacatagttgcagatttccttcttgcagttttcttctttgctgttgcaattgagctaaaacacgagcttgtaaagggcgagctgagtagcttttccaaagcaataatccctggggtgtgtgcagcaggtgggatactcgttccaatatctatttatttgtccgttgcaagtgttttgccaaacggatggcctgttccgacggccacagatgttgcattttctcttggcattttggctatttttggctcttcacttccttctaaggtgcgaatattcttattggctcttgctgtcttggatgatctggccggaatagtgataattgccacggcatttagcgtctcgataagttactggtggattattgttgcgtgcattacagttgggctttttgggttttgcagctataggctagccagatgcaagacctcaaagacatttctgatcatccctgcaatgttgctttgtgcgctcgcggcatgggtttctgtttaccagtccggtattcatgcgactatcgctggcgttatgcttggcatcatgctcaatcgtaaacagggtgcggctattgaacacgctcttgagccgtatataaacgggattattctgcccgcgtttgcttttcttgctgcaatggttcgggtaccacatttacctctggatgagataagtccggcgctatggggaattctgcttggtctgttatttggcaaactcctcggaataagcgtttttggcataatagccctgaagttcttcagaaaaaagagtatttcattcttcaacttgcttgtggtaagtgctcttggcggaattggatttacggtgtctttgctcatgaacgagctagcttttttgggaacccctgttcatgaacagggggttattgccgttttgattggttcgcttttgtctgccatattggcaattattctcatgaggtgttataaaggccgtaaatctaagtcattgccaggtacaaagggccgggtcagccattaa

SEQ ID NO: 710 - protein, 385 aa, Tropheryma whipplei strain Twist Whipple s bacillus
MSIIRSERYSAIFLLCSAALAIIFANVLDPDTWHAVHSAVSEYHIFGLITPHDIVADFLLAVFFFAVAIELKHELVKGELSSFSKAIIPGVCAAGGILVPISIYLSVASVLPNGWPVPTATDVAFSLGILAIFGSSLPSKVRIFLLALAVLDDLAGIVIIATAFSVSISYWWIIVACITVGLFGFCSYRLARCKTSKTFLIIPAMLLCALAAWVSVYQSGIHATIAGVMLGIMLNRKQGAAIEHALEPYINGIILPAFAFLAAMVRVPHLPLDEISPALWGILLGLLFGKLLGISVFGIIALKFFRKKSISFFNLLVVSALGGIGFTVSLLMNELAFLGTPVHEQGVIAVLIGSLLSAILAIILMRCYKGRKSKSLPGTKGRVSH

SEQ ID NO: 711 - DNA, 1401 bp, Streptomyces avermitilis
  CDS (1)..(1401)
atggccgccccccgcaccagcacccgcaagttcctcggacggctctcgctgcccgagcggaacttcgtcgcggaggcgctgcgcaccgagaccgtcggcggcgtcctgctcctcctcgccgcgatcaccgcgctgatctgggcgaacgtacccgcgctgcaccacagctacgagagcgtcagccacttccacttcggccccgcccccctcggcctggacctctccgtccagcactgggccgccgacgggctgctcgcggtcttcttcttcgtcgccggcatcgaactcaagcgcgagctggtcgcaggggacctcaaggaccccaaggcggccgcgctccccgtggccgccgccctgtgcggcatggccgtacccgcgctcgtctacaccctcaccaacctcaccggtggcggctccctccgcggctgggcggtacccacggccaccgacatcgccttcgcgctggccgtcctcgcggtcatcgggacctcgctcccgtccgcgctgcgcgccttcctgctcaccctcgccgtcgtcgacgacctcttcgcgatcctgatcatcgcggtcttcttcaccgccgacctgaacttcgccgccctcgccggcgccgtgatcggcctcgccgtcttctggctgctgctgcgcaagggcgtacgcggctggtacgtgtacgtgccgctcgcgctcgtcatctgggggctgatgtacaacagcggcatccacgccaccatcgccggtgtggcgatgggactgatgctgcgctgccaccgccaccagggtgaggagcacgctcccggtgagcacatcgagcatcttgtacgccccctgtcggccggcctggccgtgcccctgttcgccctgttcagcgcgggtgtcgtgatctccgggggtgcgctcggggacgtgttcaccaggccggagaccctcggggtggtcctcgggctcgtcgtcggcaaggcgatcggcatcttcggcggaacgtggctgacggcccgcttcacccgcgcgtcgctcagcgacgacctcgcctggcccgacgtcttcgcggtggcgtcgctggccggcatcggcttcaccgtctccctgctcatcggcgaactcgcgttcgacggtgatccggtgctgaccgacgaggtcaaggccgccgtcctcaccggttcccttctggcggcgctgatcgcgacgacgctgctgaagctgcgcaacgccaagtaccgtgccctgtgcgaggacgaggagcgcgacgaggacagcgacggcatccccgacatctacgagcaggacaacccggcgtaccacctgcgcatggccgagatctacgagcgcaaggccgccgagcaccgaaggcttgccgaagtgacgggcggggcaggcgcggagaacgatggtccggcataa

SEQ ID NO: 712 - protein, 466 aa, Streptomyces avermitilis
MAAPRTSTRKFLGRLSLPERNFVAEALRTETVGGVLLLLAAITALIWANVPALHHSYESVSHFHFGPAPLGLDLSVQHWAADGLLAVFFFVAGIELKRELVAGDLKDPKAAALPVAAALCGMAVPALVYTLTNLTGGGSLRGWAVPTATDIAFALAVLAVIGTSLPSALRAFLLTLAVVDDLFAILIIAVFFTADLNFAALAGAVIGLAVFWLLLRKGVRGWYVYVPLALVIWGLMYNSGIHATIAGVAMGLMLRCHRHQGEEHAPGEHIEHLVRPLSAGLAVPLFALFSAGVVISGGALGDVFTRPETLGVVLGLVVGKAIGIFGGTWLTARFTRASLSDDLAWPDVFAVASLAGIGFTVSLLIGELAFDGDPVLTDEVKAAVLTGSLLAALIATTLLKLRNAKYRALCEDEERDEDSDGIPDIYEQDNPAYHLRMAEIYERKAAEHRRLAEVTGGAGAENDGPA

SEQ ID NO: 713 - DNA, 1197 bp, Bordetella bronchiseptica Alcaligenes bronchisepticus
  CDS (1)..(1197)
atgcccacgactcctacccgcgctccatccctcctgcaggctttcctgcgctccgaagccctgggcggctatgtgctgatgatcgccgccgtcctggccctgatcgtggccaattcgccgctggcgccagcctatttccagttgctgggcaccaagctgggctatgcatcggaagccttcaccctcaaggagtcggtgctgcactggatcaacgacggcctgatggcggtgttcttcctgctggtcggcctggaaatcaagcgcgagatgctcgacggccagttgcggggcgtgtcgcgcatcgtgctgcccggcgtggcggcggccggcggcatgctgatgccggccctcgtctatctcctggtcaaccagggcgacccggcggggctgcgcggctgggccatcccggcggccaccgatatcgccttcgcgctcggcatcctggcgctgctgggcagccgcgttcccacgtcgctgaagatcttcctgaccgccctggccattctcgatgacctgggcgccatcgccatcatcgcggtgttctataccgccgagctcaatacctccgcgctagccgcggccggcggcttgctggcggcgctgtgcgtgctgaaccgcctgcgcgtgctgcgcctggcgccctatctgctggtgggcgcgctgctgtggtatttcgtcctgaaatccggcgtgcacgccacgctggccggggtggcgctggcgctggccattccgctgcgccgccaggatccgcgccagccgggcgccgagcattcgcccctgcatgcgctggagcacgccctgcaccgtcccgtggccctgctgatcgttcctgttttcggattcgccaacgccggcgtatcgttcgacggcatgggcatcgacagcctgaccgcgcccatcccgctgggcatcgcactgggcctgttcctgggcaagcagctgggcgtgttcggctttgcctggctggccatccggaccgggctggccagcatgccgcgccatgcctcgttcgcgcagctctatggcgtcgcgctgctgtgcggcatcggtttcaccatgagcctgttcatcggcgcgctggccttcgacgacgcggccaccatcgacgccaccaagatcggcgtgctgaccggctcgctggtgtcggccgtgctgggctacgcgctgctgcgcgtgctgccgccggccgactaa

SEQ ID NO: 714 - protein, 398 aa, Bordetella bronchiseptica Alcaligenes bronchisepticus
MPTTPTRAPSLLQAFLRSEALGGYVLMIAAVLALIVANSPLAPAYFQLLGTKLGYASEAFTLKESVLHWINDGLMAVFFLLVGLEIKREMLDGQLRGVSRIVLPGVAAAGGMLMPALVYLLVNQGDPAGLRGWAIPAATDIAFALGILALLGSRVPTSLKIFLTALAILDDLGAIAIIAVFYTAELNTSALAAAGGLLAALCVLNRLRVLRLAPYLLVGALLWYFVLKSGVHATLAGVALALAIPLRRQDPRQPGAEHSPLHALEHALHRPVALLIVPVFGFANAGVSFDGMGIDSLTAPIPLGIALGLFLGKQLGVFGFAWLAIRTGLASMPRHASFAQLYGVALLCGIGFTMSLFIGALAFDDAATIDATKIGVLTGSLVSAVLGYALLRVLPPAD

SEQ ID NO: 715 - DNA, 1185 bp, Haemophilus ducreyi
  CDS (1)..(1185)
atgatcgagaaaattcagaaatttctaaaattagaagccgcgggcggcattttactgttaattgctgcattattagccatgctatgtgcaaattctgtatttagcccatattatttcgaatttttacaaacacaagtcgctgtaaaattaggcgcttttagtattgataaaccgctattaatgtggattaacgatggctttatggcggtcttttttattctagtcggtatggaagtaaaacgtgagctgttagaaggttcattatcgagctatcaaaaagcgattttccctgcttttgctgcaattggtggtatggttgtaccggcccttatttattggtttattaaccgtgattatccagaatatcagcaaggttgggcaattccaatggcaacagatattgcctttgccttagggattgtggcgttattaagtaaacaagttcctgcgacattaaaggtctttttacttgcattagcaattattgacgatattggcgctattatcgtgattgcattattcttttctaatgagttaagtatgctagcacttatcattgctagcattgctattatgattttaattacaatgaatcgttacaaagtaaccggtatcattcattacgtgattgtaggcacaattctatgggcttctgtcttaaaatcgggcgtacacgcgacacttgcgggggtaattatcggcttttgtattccattacgcggtaaaaaaggcgaaactccgttacacgatttagaacatacgcttgcgccttggtgtgctttcgctattttgcctttattcgctttttcaaatgcgggcgtctctctagccggaatgagtttagctaaattaacgtctcccttaccgttgggcattacattaggtttattaattggtaaaccggttggcgtcttctctttctgctatctagctgtacgagcgggcttagccaaactgccagaaggtatcaactttaagcaagtgtttgcgatagcggtattatgtggtattggttttacgatgtctgtttttattgcgggattatcatttggtgaagaacacccagatgaaacgattcttgcattatcgaggttaggcattttaattggaaccagtattgcggcgattgttggttatattttgctaaaaaaaaccacaaataaaccgcttgtacaagcgggctaa

SEQ ID NO: 716 - protein, 394 aa, Haemophilus ducreyi
MIEKIQKFLKLEAAGGILLLIAALLAMLCANSVFSPYYFEFLQTQVAVKLGAFSIDKPLLMWINDGFMAVFFILVGMEVKRELLEGSLSSYQKAIFPAFAAIGGMVVPALIYWFINRDYPEYQQGWAIPMATDIAFALGIVALLSKQVPATLKVFLLALAIIDDIGAIIVIALFFSNELSMLALIIASIAIMILITMNRYKVTGIIHYVIVGTILWASVLKSGVHATLAGVIIGFCIPLRGKKGETPLHDLEHTLAPWCAFAILPLFAFSNAGVSLAGMSLAKLTSPLPLGITLGLLIGKPVGVFSFCYLAVRAGLAKLPEGINFKQVFAIAVLCGIGFTMSVFIAGLSFGEEHPDETILALSRLGILIGTSIAAIVGYILLKKTTNKPLVQAG

SEQ ID NO: 717 - DNA, 1383 bp, Helicobacter hepaticus
  CDS (1)..(1383)
atgcttgtagcgaactcatcgtatgcagatatgtattttactttttttcatagcgaatttggtgcattttttagtgattcgcattttaaggtaagtttgcaggattttatcaatgatgtattaatgtcatttttctttttgctcgtgggtttggaaatgaaacgcgaaatgctctatggggagctggctgggtttaaaaaagtaagtttttcttttctcgcagcatttggaggcattatatgtccagtaatgatttattcatattttaactctggcacagcatatgaaagtggttttggtgtcgcaatgagcacagatacagcctttgcacttgggcttataatgcttcttggagatagagtgcctaagattttgaagatttttcttgtaacacttgctgtagctgatgatttaggggctatttctgtaattgcaattttttattctgataatattaatatgcaatggatttatgcttctttaatccttgttgcagtacttatttatcttaattatcgtgatactaaatatctttcactatattttttggcgggtattttgttgtggttttgtgtgcaccatagcgggattcacgtaacaattgcagcagttattttggcaatggcgattcccgggcgcacacgcgtaaataaaaaatattttatcaatatgcttaaagaatttgaaagaatgaaagtagccacgaatgattggaatgatgtagtctatgcacgtgaatcggagaaggtgggtttttggagaggaagctttaagaatattagaagttttatatttggaaatcaagatgtggaaaaaaagattgatatggcaaaaacttcccaactcgtgcatatgttggatactataggcacatattctcgttatgcacaaaatccgcttatacgtcttgaaattgctctgcaacccatttgcgcttatttttttgttcctctttttgcttttgctaatgcaggtgtaacacttgaaggcaatattgatataagtttaaatagtgttatgcttgggacaattttaggcttagtagtgggcaaacctgtaggtgtattacttttttgttttttaggagagaagttaaatcttgctactcgtccaaaagatttaaattatttgcatattttatctgtgggtatgatttcaggcattggctttacaatgtctatgtttgtggcaaatcttgcctataaagatgatataatgagtattgatatgtctaaaatttctattcttgtagcatcttcaatagcagctgttcttgggcttttggtggtttatcttagcacaattaagcaggataatcagcttgagaatataaatgaagaagatgagattcaaaagcttaaggaaacacaaagtatcatttaa

SEQ ID NO: 718 - protein, 460 aa, Helicobacter hepaticus
MLVANSSYADMYFTFFHSEFGAFFSDSHFKVSLQDFINDVLMSFFFLLVGLEMKREMLYGELAGFKKVSFSFLAAFGGIICPVMIYSYFNSGTAYESGFGVAMSTDTAFALGLIMLLGDRVPKILKIFLVTLAVADDLGAISVIAIFYSDNINMQWIYASLILVAVLIYLNYRDTKYLSLYFLAGILLWFCVHHSGIHVTIAAVILAMAIPGRTRVNKKYFINMLKEFERMKVATNDWNDVVYARESEKVGFWRGSFKNIRSFIFGNQDVEKKIDMAKTSQLVHMLDTIGTYSRYAQNPLIRLEIALQPICAYFFVPLFAFANAGVTLEGNIDISLNSVMLGTILGLVVGKPVGVLLFCFLGEKLNLATRPKDLNYLHILSVGMISGIGFTMSMFVANLAYKDDIMSIDMSKISILVASSIAAVLGLLVVYLSTIKQDNQLENINEEDEIQKLKETQSII

SEQ ID NO: 719 - DNA, 1335 bp, Helicobacter hepaticus
  CDS (1)..(1335)
atggcagcaaagcaaaatagaatttcggaagcattaagtagttttatccgcgcagaatcttttagtggtatttttttatttttttgcgcagtgagtgcaatgattgtggctaattcgcctttctctgatatttataaaaacttttgggaacaaccttttggtttcagctttgcagggggattttatggatttagtattcacgattggattaatgatgtattgatgtcaattttttttcttatggttgggcttgaaattaaacgcgaattgctttttggggatttatccggattccaaaaagcagcttttcctgttataggcgcagtaggtggtatgattgtgccaggtgttatttattatgtgctcaatatgaatactccctcttatcacggatttggaatccctatggctaccgatattgcctttgcgctcggtgtcatcttgcttcttggcaaacgtgttcctttggcacttaaagtatttcttgtaacacttgctgtggctgatgatttaggagcaattgttgttattgcagtattttatccttcgcctgaaggtttgcattttatatatttaggtgtagcagcagggcttttaatacttctcacaggtatcaatcatttaggggtgcgccatttaggagtgtatatagggattggtattttgttgtggttttgtgtgcaccatagcgggattcacgcaactattgcagctgtggcattagcgttttgtattcctgtaaagcccaaaattgagagcaaggaatttattcaagtcgttcaacagatgatagaaatttttgagagcaaagacaaagagcgtaaaaatattttacttgatacgcaacaaatgagtgcaattgatgaagcagggagagattttgcaaaggtccaaaatccacttttgcgtttagagcacgctttgcaacctctgtgtgcattcattattatgcccctttttgcttttgctaatgcaggcgtagatattcgtgcagaagtaaattttcacattgaccatattatgcttggggttatacttggacttgtagtaggcaaacctttgggtattttaagtttaacatttttatgtgagaaatgtaaaattgcttcacgtccagcaggagtgtcttggagtcatatttttggtgcaggaatgctcgcaggcattggctttacaatgtctatgtttgtctcaaatcttgcatttgatgctcctcaagcaagtgatgtgtcaaaaatagcaattttgcttgcttcaagcattgcaggtattgtgggttcattgtatttgataatcaattataaaatcaactctcgggcaaaagtcaaatcttaa

SEQ ID NO: 720 - protein, 444 aa, Helicobacter hepaticus
MAAKQNRISEALSSFIRAESFSGIFLFFCAVSAMIVANSPFSDIYKNFWEQPFGFSFAGGFYGFSIHDWINDVLMSIFFLMVGLEIKRELLFGDLSGFQKAAFPVIGAVGGMIVPGVIYYVLNMNTPSYHGFGIPMATDIAFALGVILLLGKRVPLALKVFLVTLAVADDLGAIVVIAVFYPSPEGLHFIYLGVAAGLLILLTGINHLGVRHLGVYIGIGILLWFCVHHSGIHATIAAVALAFCIPVKPKIESKEFIQVVQQMIEIFESKDKERKNILLDTQQMSAIDEAGRDFAKVQNPLLRLEHALQPLCAFIIMPLFAFANAGVDIRAEVNFHIDHIMLGVILGLVVGKPLGILSLTFLCEKCKIASRPAGVSWSHIFGAGMLAGIGFTMSMFVSNLAFDAPQASDVSKIAILLASSIAGIVGSLYLIINYKINSRAKVKS

SEQ ID NO: 721 - DNA, 1323 bp, Rhodopirellula baltica
  CDS (1)..(1323)
atgaatcacatcgaaactagactcccgctaccgattcaacctattgatcggtggctacgtccgtttgcacgcttcttacacatcgaggcaaccagcgggctggtgctgattttgtgcacggtggtcgccctcgtcgcggccaactcttcttgggcagatagctatctagcgttttggcataccgatctgacgattgccgtcggtgacatcgtctttcatcactcactgcatcacgtcatcaacgatggattgatggcggtgtttttctttgtgattggtctggaagtcaaacgtgaactcgcccatgggtcgctatcggatttgaaacaggccactctgccgattgccgcggcgatcggtgggatgatcgtgccggccacgctttatctatccatgcagtacggccagcccggggtgcagggatggggcattccaatggcgactgacatcgccttcgtcgtgggatgcctggcgatccttggttctcgcgtaccgcacagccttcgagtgcttctgctttcgctcgccatcgtggatgacattggcgcaatattggtgatcgcaatcggctacaccgaatcgctggacggtcgctacttgtttctcgcagcggtcgcggtcggcgcagtccatttcctttcgcgaatcggagtgcgtcgtttcccaccgtacgtgatcgtcggcgttctcgcttggattgcgctccacgaatctggcattcacgcgacactgatcggcgtgatcctcggactgatgactcctgccacgccgacattggtgcccgagcgttttcgcgaatacttgcacgaaaaggagcacgaatttcaaccgaaggagtggagtcggcggctacaccgcgctgaggtggttcgagaagttcagcagctcacgcgagaaacagtttcaccgctggagtacttggaggtaacactgcacccttggaccgcctatgtgatcatgcccgtcttcgcgctcgcgaatgcgggagtgttgattgaaccggccaacctgagtgactccgttgcaatcgcggtcgtgatcggtctggtcgtcggcaagccacttggaattgcgctgttcagttggttggtgattcgattgggcgtggcacgtttgccgagcggtttgaactggccaattttgatgtcgggaagtttccttgccggtatcggattcacgatggcattgttcatcgacgggttggcattcggagccgatgggctcgatactgccaagactggcgtgctggtcgggtccgcaatcagcgcaatcgctgggatgggactgctgctgtggactctgcccaaaccaactcgtcaataa

SEQ ID NO: 722 - protein, 440 aa, Rhodopirellula baltica
MNHIETRLPLPIQPIDRWLRPFARFLHIEATSGLVLILCTVVALVAANSSWADSYLAFWHTDLTIAVGDIVFHHSLHHVINDGLMAVFFFVIGLEVKRELAHGSLSDLKQATLPIAAAIGGMIVPATLYLSMQYGQPGVQGWGIPMATDIAFVVGCLAILGSRVPHSLRVLLLSLAIVDDIGAILVIAIGYTESLDGRYLFLAAVAVGAVHFLSRIGVRRFPPYVIVGVLAWIALHESGIHATLIGVILGLMTPATPTLVPERFREYLHEKEHEFQPKEWSRRLHRAEVVREVQQLTRETVSPLEYLEVTLHPWTAYVIMPVFALANAGVLIEPANLSDSVAIAVVIGLVVGKPLGIALFSWLVIRLGVARLPSGLNWPILMSGSFLAGIGFTMALFIDGLAFGADGLDTAKTGVLVGSAISAIAGMGLLLWTLPKPTRQ

SEQ ID NO: 723 - DNA, 1167 bp, Photorhabdus luminescens subsp laumondii
  CDS (1)..(1167)
atgacagcaattattcgtcaattcctgaaattagaagcggctggagggcttcttcttatcatcactgccattattgcgttgataatggcaaactcgccattacagggtatttatcagcaatttcttaatatttcggtggcagtacaattcgctgcactggagatcaataagcctttgttgttgtggattaatgacggcttgatggcggtcttctttttgattgttggtttggaagtaaaacgggaactgttggaaggctctttggcagggcgtgataaggcactatttccggtgatagcggcgataggtggtatggtcgctccggcactaatatatctactctttaatggcaatgatgagtttacccgtcagggttgggctattcctgcggcaaccgatattgcttttgccttgggtgtgatggcgctattgtctaagcgagtaccaacagaactcaaggttttcttgttggcacttgcgattattgatgatctgggcgttatcgtgattatcgctctgttttataccaaaacggtttctcttgtggcgcttggattgtcagcggcaatgattgctttgctggtttggatgaattggcgcggtgtcgaaaaaacatcggcttatttggctgttggcgctatcctttgggtttgcatcttgaaatcgggtgttcatgcaacactcgccggcgtcattgttggttttctgattcctctgcgtggccagaatggtcattcaccatctgaattacttgagcacggtttgcatccttgggtggcgtatcttattttgccattatttgcatttgccaatgcaggtgtagccctgaatggcgttacgttaaatggtttgaccgatatattgccgttaggtattgctgtggctctgtttcttggtaaaccattgggcatttttctttttagctatatttctattcagatcggatttgctaaattgccacagcagattaatcttaaacagatatttgcggtttctgttctttgtggaattggctttactatgtctatctttatttcaggattggcttttgaaggggtggatgaatctttcagtgtctattcccgtcttggcattctgatgggttcaaccatcgctgcgtttatggggtatggcttgttacgaatggtcttaccaaagaaaaagtaa

SEQ ID NO: 724 - protein, 388 aa, Photorhabdus luminescens subsp laumondii
MTAIIRQFLKLEAAGGLLLIITAIIALIMANSPLQGIYQQFLNISVAVQFAALEINKPLLLWINDGLMAVFFLIVGLEVKRELLEGSLAGRDKALFPVIAAIGGMVAPALIYLLFNGNDEFTRQGWAIPAATDIAFALGVMALLSKRVPTELKVFLLALAIIDDLGVIVIIALFYTKTVSLVALGLSAAMIALLVWMNWRGVEKTSAYLAVGAILWVCILKSGVHATLAGVIVGFLIPLRGQNGHSPSELLEHGLHPWVAYLILPLFAFANAGVALNGVTLNGLTDILPLGIAVALFLGKPLGIFLFSYISIQIGFAKLPQQINLKQIFAVSVLCGIGFTMSIFISGLAFEGVDESFSVYSRLGILMGSTIAAFMGYGLLRMVLPKKK

SEQ ID NO: 725 - DNA, 1359 bp, Porphyromonas gingivalis Bacteroides gingivalis
  CDS (1)..(1359)
atgaaacagacttttcgctttatcaaaccaattgaacggattactcacctgaagccgaatgctacgatgatgttgttcttggcttcggtgttggcagtcatcatggctaatagttcgttgagtactatctatcatgaaattttagagtaccctatcaatcttacgatcggaggtcatgaggtcttttctcatcatggagagaccatgaccttgctccagtttgtgaatgatgtgctgatggtcattttcttccttgctgtcggtttggagatcaagcaggagattttggtcggcgaattgtcttctttcaagaaagctatgctccccattgtaggagccataggagggatgatcgtccctgtccttttcttcctgctggttgttcatgaaggccctggtgcaagaggtgctgccatccctatgtctacggatatagcttttgccttggcggccttggctgttttgggaagtcgggttccggcaagcctcaaggtattcctgacggctttggctgttgccgacgatataggtggtattatcgttattgcgctcttctatagttcccatatcaacatcgggatgttggccattgccttcggtatcctattcatcatgtatttgatggggcgtatgcatgtgagcaacttagggctttacttcgtctgtactttctttgtttggctctttttcctacagagcggtatccataccacaatagccggtgtgctggcagctttcatgattccggcccgtcctggactacatgccaagaatcttcgtgccgagatgcgttcccttttcgaggcaatgcccaatgacaagatacgacaatcaggtagctctctgatcttgagccataaccaaatcaacgtaatcaactccatgcgtaagattgcgcgtaaggctataagtcctatgcagctcatggaagagtatctcagcccgatagtaggctacttcgtcttgcctctctttgcctttgccaatgctggcatcacgctcggaggagtcacggcagatgccttgtggggcgtgccgatggctgtattcttgggcttgtttgtcggcaaacctttgggtatttactttttcacctatggttttgtcaagatgaggctctgcccttggcctgaaggaatgagccgcctcaacctgatggcagtctccttatttggaggtatcggttttactgtttccctctttatcgctaccctttcttacgccggagccgagcatttgctcttcctcaacgaggccaagctcggtatcttcgttgcttcgattttcgctgctctggtcggtatcgttacattgcgatatgagctgaatctggaaagcgccaaggcgcaaaagagttaa

SEQ ID NO: 726 - protein, 452 aa, Porphyromonas gingivalis Bacteroides gingivalis
MKQTFRFIKPIERITHLKPNATMMLFLASVLAVIMANSSLSTIYHEILEYPINLTIGGHEVFSHHGETMTLLQFVNDVLMVIFFLAVGLEIKQEILVGELSSFKKAMLPIVGAIGGMIVPVLFFLLVVHEGPGARGAAIPMSTDIAFALAALAVLGSRVPASLKVFLTALAVADDIGGIIVIALFYSSHINIGMLAIAFGILFIMYLMGRMHVSNLGLYFVCTFFVWLFFLQSGIHTTIAGVLAAFMIPARPGLHAKNLRAEMRSLFEAMPNDKIRQSGSSLILSHNQINVINSMRKIARKAISPMQLMEEYLSPIVGYFVLPLFAFANAGITLGGVTADALWGVPMAVFLGLFVGKPLGIYFFTYGFVKMRLCPWPEGMSRLNLMAVSLFGGIGFTVSLFIATLSYAGAEHLLFLNEAKLGIFVASIFAALVGIVTLRYELNLESAKAQKS

SEQ ID NO: 727 - DNA, 1359 bp, Wolinella succinogenes
  CDS (1)..(1359)
atggcagagaatcaagattacgcttcgggaaatggtggcatcaaagcgctacttctcaacttcatccacagtcagtcctttagtgggattttcctcttcttttgtgctgtagtcgcgatgattagcgccaactcggcattgagcgagagctactttcatctctggcatacagagatcgggtttttcatcggtgagacctttattggcatgagtctccatcactggatcaatgatgttcttatgtctttcttcttcttgatggtggggctagagatcaagcgcgaattgctctttggggagcttgcaggtattaagcgcgctgcttttcctgctattgccgctttgggtgggatgatcgttcccgcgattgtttatacgctctttaactttggcaccgattcggcgcatggctttggtattcctatggctaccgatattgcctttgccttgggtgtgcttctcctcctgggagacaaagtctctttggcgctcaaagtctttcttgtctctttggcggtagtggatgacctaggcgcggtggtagtgattgctattttttacaccgaagaccttcaaacgctttggcttctctattctgtcgtgattttagggcttcttattggacttaacaaaatgggtgtgcgatcgctcttcccctatgcgattcttggagtgttgctctggattaccgtgcataactgtggaattcacgccacaatcgctgctgtggcgctggccttcacgattcctgtgaagccaaaaattgagagtgagaactttgcccaagaggctaaagagttattggagcgattcttgagccatgacaaagagcgtgccaatcttcttttagcgagcgagcaggtgcatagcgtcgagttgctcagcaagcactctaagagcgttcaaagtccgctagtgagacttgagcatgccctccatccttggagcgcctacttcattatgcccgtctttgcttttgccaacgcgggtgtggccatcagtagtaatattcattttgatattgatggggtgttgccaggaatcatgcttggccttattgtgggtaaacctgtgggaatcctcggactcacctatttagccgagaagatgggaattgccacccgaccagaaggggtcatgtggattgatattttgggggcaggaatgcttgcagggattggtttcaccatgtctatttttatcaccaacctcgccttcaccaaccctgaagccaccgatgtggctaaaatcgccatcctctctgcttcattgtttgcaggagctttgggttatttcttcatttcgattcgatgccgcttcaaaaagaaaaaagaggcttgctgcacgatcaaaagctaa

SEQ ID NO: 728 - protein, 452 aa, Wolinella succinogenes
MAENQDYASGNGGIKALLLNFIHSQSFSGIFLFFCAVVAMISANSALSESYFHLWHTEIGFFIGETFIGMSLHHWINDVLMSFFFLMVGLEIKRELLFGELAGIKRAAFPAIAALGGMIVPAIVYTLFNFGTDSAHGFGIPMATDIAFALGVLLLLGDKVSLALKVFLVSLAVVDDLGAVVVIAIFYTEDLQTLWLLYSVVILGLLIGLNKMGVRSLFPYAILGVLLWITVHNCGIHATIAAVALAFTIPVKPKIESENFAQEAKELLERFLSHDKERANLLLASEQVHSVELLSKHSKSVQSPLVRLEHALHPWSAYFIMPVFAFANAGVAISSNIHFDIDGVLPGIMLGLIVGKPVGILGLTYLAEKMGIATRPEGVMWIDILGAGMLAGIGFTMSIFITNLAFTNPEATDVAKIAILSASLFAGALGYFFISIRCRFKKKKEACCTIKS

SEQ ID NO: 729 - DNA, 1149 bp, Geobacter sulfurreducens
  CDS (1)..(1149)
atgagaaaaaggatcaacctgctgcgtgaattttcggtgcctctgatcgccggtgtcgtggtggccctgctctgggccaacctcgacccggccggctaccactctttcatagaacagcccttcttcggtgggatgagcttccacttcgtggtgaatgagctgttcatggtcctttttttcggaatagcggcagttgaaataactcaaagctgcctgccgggcggcgatctgaatccgttgagaaaggcggtcaatccgcttctggcgactcttggaggggtcgtcggcccggtgctcgtctacctgggactcaacgccatcatcggtggtccggaactgacgcgcggctggggtatccccaccgccaccgatatcgcgctggcatggctggtagcccggctcgtcttcggagccgggcatcccgcggtatcgtttctgcttctgctggcggtagcggacgatgccataggacttgccatcattgccgtattctatcccgacccgaaccacccgaccgagccgatctggcttttcctgacggtcgccggcatggttgtcgcctatatcctcaggagcctgaaatcaagaagctactggccctatgtagtcgtgggaggcggacttgcatggaccggcctgttcaaggcccacttgcacccagccctcgccctcgtcttcatcattcccttcctgccgcatccaagccgggaaacggctcacctgttcgaggccgatccgcgcgacacctcgaccctggcccggttcgagcatgattggaagatcgtcgtcgacttcggtctcttcatgttcggccttgccaatgcgggagtcggtttttcgtccgtgggggcggcaacctggctcgtgctggcatcgctcgtaatcggcaagacgctcggcatctttgccatgggatacgttggcagggccctcggattccccctgccgcagcaggtcggcgccaaggaactggccatgacggggctggtggcgggcatcggcctgaccgtggccctgtttgtggccggtgtggcatttgttgaaccggacatccaggggtcggccaaaatgggggcccttttgtcgggaggtgtctccattgtggcgatcatgctcggaagagcgctgaacgtgagacgaatcccctga

SEQ ID NO: 730 - protein, 382 aa, Geobacter sulfurreducens
MRKRINLLREFSVPLIAGVVVALLWANLDPAGYHSFIEQPFFGGMSFHFVVNELFMVLFFGIAAVEITQSCLPGGDLNPLRKAVNPLLATLGGVVGPVLVYLGLNAIIGGPELTRGWGIPTATDIALAWLVARLVFGAGHPAVSFLLLLAVADDAIGLAIIAVFYPDPNHPTEPIWLFLTVAGMVVAYILRSLKSRSYWPYVVVGGGLAWTGLFKAHLHPALALVFIIPFLPHPSRETAHLFEADPRDTSTLARFEHDWKIVVDFGLFMFGLANAGVGFSSVGAATWLVLASLVIGKTLGIFAMGYVGRALGFPLPQQVGAKELAMTGLVAGIGLTVALFVAGVAFVEPDIQGSAKMGALLSGGVSIVAIMLGRALNVRRIP

SEQ ID NO: 731 - protein, 609 aa, Consensus
  misc_feature (1)..(37): Xaa can be any naturally occurring amino acid
  misc_feature (39)..(40): Xaa can be any naturally occurring amino acid
  misc_feature (42)..(47): Xaa can be any naturally occurring amino acid
  misc_feature (49)..(51): Xaa can be any naturally occurring amino acid
  misc_feature (54)..(60): Xaa can be any naturally occurring amino acid
  misc_feature (62)..(90): Xaa can be any naturally occurring amino acid
  misc_feature (92)..(93): Xaa can be any naturally occurring amino acid
  misc_feature (95)..(95): Xaa can be any naturally occurring amino acid
  misc_feature (97)..(99): Xaa can be any naturally occurring amino acid
  misc_feature (102)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(114): Xaa can be any naturally occurring amino acid
  misc_feature (116)..(117): Xaa can be any naturally occurring amino acid
  misc_feature (119)..(126): Xaa can be any naturally occurring amino acid
  misc_feature (128)..(129): Xaa can be any naturally occurring amino acid
  misc_feature (132)..(132): Xaa can be any naturally occurring amino acid
  misc_feature (135)..(137): Xaa can be any naturally occurring amino acid
  misc_feature (139)..(176): Xaa can be any naturally occurring amino acid
  misc_feature (179)..(180): Xaa can be any naturally occurring amino acid
  misc_feature (182)..(182): Xaa can be any naturally occurring amino acid
  misc_feature (190)..(196): Xaa can be any naturally occurring amino acid
  misc_feature (198)..(200): Xaa can be any naturally occurring amino acid
  misc_feature (202)..(203): Xaa can be any naturally occurring amino acid
  misc_feature (205)..(206): Xaa can be any naturally occurring amino acid
  misc_feature (209)..(210): Xaa can be any naturally occurring amino acid
  misc_feature (213)..(214): Xaa can be any naturally occurring amino acid
  misc_feature (217)..(222): Xaa can be any naturally occurring amino acid
  misc_feature (225)..(225): Xaa can be any naturally occurring amino acid
  misc_feature (227)..(272): Xaa can be any naturally occurring amino acid
  misc_feature (274)..(276): Xaa can be any naturally occurring amino acid
  misc_feature (278)..(280): Xaa can be any naturally occurring amino acid
  misc_feature (282)..(286): Xaa can be any naturally occurring amino acid
  misc_feature (289)..(289): Xaa can be any naturally occurring amino acid
  misc_feature (291)..(291): Xaa can be any naturally occurring amino acid
  misc_feature (293)..(293): Xaa can be any naturally occurring amino acid
  misc_feature (297)..(302): Xaa can be any naturally occurring amino acid
  misc_feature (304)..(390): Xaa can be any naturally occurring amino acid
  misc_feature (392)..(395): Xaa can be any naturally occurring amino acid
  misc_feature (397)..(398): Xaa can be any naturally occurring amino acid
  misc_feature (400)..(400): Xaa can be any naturally occurring amino acid
  misc_feature (402)..(408): Xaa can be any naturally occurring amino acid
  misc_feature (410)..(410): Xaa can be any naturally occurring amino acid
  misc_feature (413)..(414): Xaa can be any naturally occurring amino acid
  misc_feature (418)..(442): Xaa can be any naturally occurring amino acid
  misc_feature (445)..(446): Xaa can be any naturally occurring amino acid
  misc_feature (449)..(450): Xaa can be any naturally occurring amino acid
  misc_feature (452)..(467): Xaa can be any naturally occurring amino acid
  misc_feature (469)..(481): Xaa can be any naturally occurring amino acid
  misc_feature (483)..(483): Xaa can be any naturally occurring amino acid
  misc_feature (489)..(489): Xaa can be any naturally occurring amino acid
  misc_feature (491)..(491): Xaa can be any naturally occurring amino acid
  misc_feature (494)..(495): Xaa can be any naturally occurring amino acid
  misc_feature (499)..(515): Xaa can be any naturally occurring amino acid
  misc_feature (517)..(518): Xaa can be any naturally occurring amino acid
  misc_feature (520)..(525): Xaa can be any naturally occurring amino acid
  misc_feature (527)..(529): Xaa can be any naturally occurring amino acid
  misc_feature (531)..(609): Xaa can be any naturally occurring amino acid
XXXXXXXXXXXXXXXXXXXXXXXXXXXXXXXXXXXXXGXXLXXXXXXAXXXANXXXXXXXYXXXXXXXXXXXXXXXXXXXXXXXXXXXXXWXXDXLXXXFFXXXGXEXKXEXXXGXXLXXXXXXXXPXXAAXGGXXXPXXXXXXXXXXXXXXXXXXXXXXXXXXXXXXXXXXXXXXGWXXPXATDIAFAXXXXXXXGXXXPXXLXXFLXXLAXXDDXXXXXXIAXFXXXXXXXXXXXXXXXXXXXXXXXXXXXXXXXXXXXXXXXXXXXXXXYXXXGXXXWXXXXXSGXHXTXAGVXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXEXXLXPXXXXXXXPXFAXXNAGXXXXXXXXXXXXXXXXXXXXXXXXXGLXXGKXXGXXXXXXXXXXXXXXXXPXXXXXXXXXXXXXLXGIGFTXSXFIXXLAFXXXXXXXXXXXXXXXXXLXXSXXXXXXGXXXLXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 732 - DNA, 1980 bp, Saccharomyces cerevisiae; identical to SEQ ID NO: 13
  CDS (1)..(1980)

SEQ ID NO: 733 - protein, 659 aa, Saccharomyces cerevisiae; identical to SEQ ID NO: 14

SEQ ID NO: 734 - DNA, 26 bp, Unknown
  primer
atggatagtacgaatttgaacaaacg

SEQ ID NO: 735 - DNA, 26 bp, Unknown
  primer
ttagagtatttccagatctgaatctg

SEQ ID NO: 736 - DNA, 924 bp, Saccharomyces cerevisiae
  CDS (1)..( 249)
atggttcagcaactaagcctttttggatctattggtgatgacggctacgatttactaatttcaactttgaccacaatatcaggtaatcctccgctactgtataacagtttatgcactgtctggaaaccaaatccatcttacgacgtcgagaacgtgaactctagaaaccaattggttgaaccaaatagaataaaactttccaaagaggtgccattttcttacctgatcgatgaaacaatgatggataagccattaaactttagaatcttgaaatcttttacaaacgataaaatcccgcttaactatgctatgacacggaatatcttgcacaacacagttccgcaagtcaccaacttcaacagcacaaacgaagatcaaaacaacagtaagcatacagaagatactgtaaatgaaagtcgaaacagcgatgacatcatagatgtcgacatggatgcaagtcccgccccttcaaacgagtcatgttccccttggtcattgcaaatttcagatattcctgctgcaggaaacaatagaagtgtttcaatgcaaacgatagctgagactatcatattatcttcagctggcaaaaactcttcagtatcctcgctcatgaacggattgggttatgtattcgaatttcagtatcttacaattggtgtgaaattttttatgaagcatggtttaatacttgagttacaaaaaatttggcaaatagaagaagcaggcaattcacaaataacaagcggagggttccttttaaaagcatacatcaatgttagtagggggaccgatatcgatcgtataaactatacagagactgccttgatgaacttaaaaaaggaactacaaggctatatagagttaagtgtacccgatagacagtcaatggactcgagggtagcacatggaaatattctaatataa

SEQ ID NO: 737 - protein, 307 aa, Saccharomyces cerevisiae
MVQQLSLFGSIGDDGYDLLISTLTTISGNPPLLYNSLCTVWKPNPSYDVENVNSRNQLVEPNRIKLSKEVPFSYLIDETMMDKPLNFRILKSFTNDKIPLNYAMTRNILHNTVPQVTNFNSTNEDQNNSKHTEDTVNESRNSDDIIDVDMDASPAPSNESCSPWSLQISDIPAAGNNRSVSMQTIAETIILSSAGKNSSVSSLMNGLGYVFEFQYLTIGVKFFMKHGLILELQKIWQIEEAGNSQITSGGFLLKAYINVSRGTDIDRINYTETALMNLKKELQGYIELSVPDRQSMDSRVAHGNILI

SEQ ID NO: 738 - DNA, 25 bp, Saccharomyces cerevisiae
atggttcagcaactaagcctttttg

SEQ ID NO: 739 - DNA, 27 bp, Saccharomyces cerevisiae
ttatattagaatatttccatgtgctac

SEQ ID NO: 740 - DNA, 2835 bp, Escherichia coli
  CDS (571)..(2712)
cccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctt

SEQ ID NO: 741 - protein, 713 aa, Escherichia coli; identical to SEQ ID NO: 259

SEQ ID NO: 742 - DNA, 2220 bp, Hafnia alvei; identical to SEQ ID NO: 288
  CDS (1)..(2220)

SEQ ID NO: 743 - protein, 739 aa, Hafnia alvei; identical to SEQ ID NO: 289

SEQ ID NO: 744 - DNA, 2199 bp, Escherichia coli; identical to SEQ ID NO: 290
  CDS (1)..(2199)

SEQ ID NO: 745 - protein, 732 aa, Escherichia coli; identical to SEQ ID NO: 291

SEQ ID NO: 746 - DNA, 1850 bp, Bacillus subtilis
  CDS (312)..(1785)
aagctttaagcagttcttcacgatccgcccctttttcatatgcaagctcaacctgctggaaaaatgcaatcacatccactgcttcttcggttgtccaatcttcattcatcggatattgatactccattttcttcactccttgtagatttacttcccttaagagaaagcatcttcatttgatcataaattgttctttacattctttcaagttcataatataattcatttgttttacgtctaaaaaacggttgagaaactgattttaatacacactattatgcataggtatgattacaaaggtgggaaaacaaatgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggtgataaaattattattccaagaaatgttcataaatcaattatgacagctattgtattttccggagcggttccaatttttattcatcctgaaattgacaatgaattgggcatctcccacggaattacacttgaatctgctaaacgggcgcttaccgagcatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattgccgctatcggctatgcaggcaggagcggacatagcagcgacaagtgtacacaagctgggcggatcactgacacaaagctctattttaaacatgagagaaggccttgtatctaaagacagagtgcaatccatcctgagcatgctgacaactacgtcaacttcttacttgcttctcgcttctttggatgttgccagaaaacgccttgcaacagaaggccgccagcttgctgaggaaacactcaagcttgccaatcagacgagagatcgcctcaatcagattgaaggcatttattgtgtcggttctgagattcttgggtcgaaagcagcttacagctatgatccgacaaaattgattatctctgtgaaaagtcttggcctgacaggacatgacgtggaaaaatggcttcgtgaatcctttaatattgaggtggagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaatacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataaaaaataaaaagccatgcggctttaagccgcatgcttttttttactcttcatcaacaggacattgac

SEQ ID NO: 747 - protein, 490 aa, Bacillus subtilis; identical to SEQ ID NO: 265

SEQ ID NO: 748 - DNA, 1449 bp, Bacillus halodurans
  CDS (1)..(1449)
atgaaaaaagcctcaacattgccgctatttgaacggctcgttcagcatgatcgcgggggacctatctcgtgccatgttccaggccataagcagggggctctttttcataaggatgcctgttcatattttcaaagcattttatcccttgatgtaacggagctaaccggccttgatgatctccatgatcccagaggagttattgcagaggctcaagctttgacagcccgctacgtcggggcagaagcgacgtgttttttagtcaatggctcgacggttggtaatttggcaatgattttaggtacacttgagcctggcgatactgtttttgtacaaagggattcgcataaatcggtgatgaatgggttagcgatggcaagggtccatccaatctttctttcaccatcctacgatgagagaacgcaattaccaacaggtattaccgaacaaacgttaaaacaagcactaatagaacacccgaatgggaaagcacttattttaacatatccatcgtattatggggttgcccgctcgatccgtccgctcgtccagatggcgaaagaagctggattgtacgtacttgtggatgaggcgcacggagcacattttccggtaggtgatccatttccgaaacaagcacttgagcaaggggccgacgtagtcgttcaatctgcgcataaaaccttacccgccttaacaatgggctcctatcttcactttgctcatggactacattcgaaaatcaaggattccattcgagagcaattgcagattttgcagtcgagcagcccatcctatccgattcttgcctcattagatgcagcaagaggatttttagaggatctcacgaatgtaaaagatacgctcgattccatcgcggagatgaataggcggattgaacaggtcgagcgtttgtcggttgctacattttccccgctacccaccgatccattaaaaacggtgattacagtagaaggggcaacaggatttgccttgcaaaccgaacttgaaaaagaggggatatactcagagctggcagacgatcgtcatgttttgcttatgtgggggctaacccctttacagaaagtccgacaagaggaaatcatcgacaaaatgtgccgagcaaccaagcggcttcctgcgcttgagcaaataagtaaagggtgccccctatcgttatcgtggcaagcacacacgtcgcttgatctatcatatgatgaacaaaaacgatattcaattgaagaggttgccgtggaagaggctgtggggaaagtgagtggagcaacggttatcccttatcccccaggggtacctctcctattaaaaggggaaaaaatcacagaaccgttaattgcccaatttcagcagttgcaggaggcaggggcccgttttcaggggagaccttctgagcaacaagggttgtatgtgtttacgttggaggctatgacatga

SEQ ID NO: 749 - protein, 482 aa, Bacillus halodurans; identical to SEQ ID NO: 271

SEQ ID NO: 750 - DNA, 2196 bp, Sinorhizobium meliloti
  CDS (1)..(2196)
atgcgcagcctcgcagaggcgattgaaaaggaaggttatcgggtcgttgcagggctcacctatgaggatgcacgccgcctcgtgaacgtcttcaacaccgagtcctgctggctgatttcagtcgacgggacggaatcaagtacgacgcgctgggagattttagccgagctgctcgccgcgaaacgctcccggaacaacctgctgccaatctttctgtttggcgacgatacaacggcggaaatggtgccggcgcccgtgctgcgccacgccaatgcctttatgcgtcttttcgaggattctccggaattcatggcgcgcgcgatcgtgcgcgcggcgcagaattatcttgagaggcttccgcctccaatgttcaaggcgttgatggaatacacgcttcacggcgcctattcctggcacacgccagggcacggaggcggggtggcgtttcgcaagagcccggttggccagctcttttatacgttttttggagagaacacattgaggtcggacatttctgtgtccgtcggcagcgttggttcgctcctcgatcatgttgggccgattggcgagggtgagcgcaatgccgctcgcatatttggtgcggatgagacgctgttcgttgtcggcggcacctcgaccgccaataagatcgtgtggcagggtatggtcactcggaacgacctcgtcctctgcgaccgaaactgccataagtctatcctgcactcgctgattatgacgggtgcaacgccgatttacctgacgccctcacgcaacggcctcggcatcatcggaccgattgcgaaggagcagtttaccccagaggcaatcgcgcacaagatcgtcgccagtccgtttgccagtgagacgaacggtaaagtgcgcctgatggtagtgacaaactccacctatgatgggctctgctacaatgtagatggaatcaaatcggcgctcggcgatgcggtggaggtactgcatttcgacgaggcctggtttgcttacgccaattttcacgaattctacgatggttatcacgcgatctcttcaacgaagcccgcgcgctcgcaagaagccatcacattcgcaacccagtccacgcacaagctgctggccgccttctctcaagcttcaatgcttcatgtgcagcatgccgtggcgaagcaactcgacatcacacgcttcaacgaagcgttcatgatgcacacatcgacatcgccgcaatatgggatcatcgcctcgtgcgacgtggctgctgccatgatggagcagcccgccgggcgggcgctggtacaggagaccattgacgaagccatgagtttccgccgagccgtcaacgccgtgcggacacagatgcaggattcctggtggttcgaagtctgggagccccccatcgcggatcgggccccgagcgacgccacgtcggattggcttctaaagcccggtgacgcttggcatggtttcgaagacctggctgagaatcacgttatggttgacccgatcaaggtcacgatcctttcgcccggactcaatgcgggcggagcgatgctggagcatggtattccggctgcagtcgtcacgaagttcctttcttctcgccggatcgaaatcgagaaaaccggcctctactctttcctggtgctcttctccatggggatcacacggggcaagtggagcaccctgatcaccgagctcttgaacttcaaagacctctatgatgccaatgcgcctctttcacgcgcccttcccgccctcgcggcagcccatccggacgtctaccgtgcaatgggccttagagatctttgcgagaaaattcacgacgtgtaccgcagcgatggcgtgccgaatgcccagcgcgagatgtacaccgtgctacccgaaatggcactgcgcccggcagacgcctacaaccgcctggtcaaggggtgcgtcgaaagcgtcgatatcgacgaattgatcggccggacactcgcagtcatgattgtaccctatcctccgggcatcccgctcatcatgcctggcgagcggatcactgcagccacaagatcgatccaggactatctcgtctacgcccggagtttcgacaggaaattcccgggatttgagacggacatccacggactccgtttcgtcgctaacccgagtggacggagatatctcgtggattgcatcgtcgaggagggacaagatgataccgcgtga

SEQ ID NO: 751 - protein, 731 aa, Sinorhizobium meliloti; identical to SEQ ID NO: 297

SEQ ID NO: 752 - DNA, 2196 bp, Escherichia coli; identical to SEQ ID NO: 298
  CDS (1)..(2196)

SEQ ID NO: 753 - protein, 731 aa, Escherichia coli; identical to SEQ ID NO: 299

SEQ ID NO: 754 - DNA, 2199 bp, Escherichia coli
  CDS (1)..(2199)
atgtcagaattaaaaattgccgttagtcgttcttgcccggattgtttttccactcatcgtgcatgcgtgaatatagacgaaagtaattatattgacgttgccgccattattttatcagtcagtgatgttgaacgtggaaaactcgatgaaatagacgctactggctatgacattcctgtttttattgcaacggaaaatgaagaacgtataccagcagaatatctttcacgtatttctggtgtcttcgaacatggagaagcacgcaaagaattttatggtcgtcagttagaaaccgctgccagccattatgaaactcaactgcgcccacctttctttcgcgcactggtcgattatgtcaatcagggcaacagcgcatttgactgccccggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcagcaaaagtgtttaatgccgataaaacctacttcgttttaaatggcacttcatcttctaacaaagtggttttaaacgccctgctgacaccgggtgatctggtgctatttgaccgcaataaccataagtctaaccaccacggggccttgctacaggctggtgcaacaccggtttatctggaaacagcacgtaacccgtatggttttatcggtggtattgatgcacactgcttcgaagaaagttatctgcgtgaactgattacagaagttgcaccgcaacgggcaaaagaggcgcgtccgttccgcctcgctgtgattcagctaggcacctacgacggtacgatttataacgcccgccaggtggtggataaaattggtcatctgtgtgactacatcctgtttgattccgcatgggtcggctatgaacagtttattccgatgatggctgactgttcgccgctgttgctggatcttaatgagaacgatccgggtattctggttacgcaatccgtacataaacagcaggctggtttttctcaaacttcacaaatccataaaaaagacagccacatcaaagggcaacagcgttatgtaccgcacaaacgcatgaacaacgcctttatgatgcatgcctccaccagcccgttctatccgctgtttgccgcactggatatcaacgccaaaatgcatgaaggtgtcagcggtcgtaatatgtggatggattgtgtggtaaatggcattaatgcccgcaaactgatcctcgataactgtcagcatattcgtccgttcatacctgaactggtggatggtaaaccctggcagtcgtatgaaacagcgcaaattgcggttgatctgcgcttcttccagtttgtaccaggtgagcactggcattcttttgaaggctatgcagagaatcaatactttgttgatccgtgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgctggaatctgatgcgccgctggcggaagtgctaccttccatctacaaacagcatgaagagcgctacgccggttatacccttcgtcagttgtgccaggaaatgcatgatttgtatgcccgccacaacgtgaaacaactgcaaaaagagatgttccgtaaggaacacttcccacgcgtcagcatgaatccgcaagaagctaactacgcctatttacgcggtgaagtggagctggttcgtctgccggatgcagaaggccgtatcgctgccgaaggtgcgcttccttatcctccgggtgtgctgtgtgttgttccgggtgaaatctggggtggtgctgttttgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgctgaaaggggaaaaattatga

SEQ ID NO: 755 - protein, 732 aa, Escherichia coli; identical to SEQ ID NO: 301

SEQ ID NO: 756 - DNA, 1458 bp, Zea mays.
  CDS (1)..(1458)
atgcctctggtctgtgcactgcaattaactgccagacaagatgtttcctgctttcacttcccaggacacaacagaggaaaagctgctccatcttccttgtcgaaactcattggctcaggggcatttctgcatgacttgcccgagctacccgagctcgatgatctcttctccccaaaaggtgtgattctagatgcccagaggcgagcagctcaactgtttgggtcatctaaaacttggttccttgtcaacggaacgacctgtggaatccaggcctcagtgatggctacctgttctcctggcgactacctcattgtgccacggaactgccacctttcagtgatctctgcgctggtcttgtctggtgtggtgcctaaatacataataccagaatataattctgggtgggacattgctggtggtatcaccccgctgcagctggatgaagcagtaaaagagctggaggaggatgggaagagggtaggcgctgttcttgttacttcacccacctaccatggtgtatgcagcaatgtgcaaggtattgtcagtgtttgtcatccacgaggcattccggttatagttgatgaagcgcatggtgcacatttcaggttccatgacagtttgccaagcactgcaattgagcaaggtgctgacctagctgtgcaatccacacacaaggtcctgtgctcccttacacagtcttcaatgcttcacatgtctggagatcttgtcgatgtagataaagtaagccagtgccttcagctcctccagagctcgagcccgagttaccttctactgtcatctttagatgccgcgagagatcagctgagccagaacacaaatatatttgatgagccattagctatagcatcggaaacaaaagacctgctggcgagaatccctgggatatctgttctagacttaccatgctttgcttctgatttccctgccattgatccgttgcgcatcacactcagtgcctcagatctgcaattatcgggatacgaagccgatgacattttatatgaaggccatcaaatcgtatctgagcttgttggcacaagggccgtgacatttgcagtcaacttaggaaccagagtgcaggacgctgagaagcttgtgcagtctgcaaagcatctatcagaaaaacatttctttgcaaatagcctgaaacccgtgaaggagaatcgtgtgcatggcccattagagaatatctctgtgcatctgagtccaagagaggccttctttacagagaagaggagagtgaaaatcgaggacagccttggtgaaatctgtggtgagctaatatgcccgtatccacctggtatcccagttctgattccaggcgaggtagtaacccatgattcactgtcctacttgatgagcgttagacaccaaggcatcacgatcagtggagcggctgatgctgagctaaattccattctggtgtgcgacttatga

SEQ ID NO: 757 - protein, 485 aa, Zea mays.; identical to SEQ ID NO: 263

SEQ ID NO: 758 - DNA, 2853 bp, Mycobacterium avium subsp. paratuberculosis
  CDS (1)..(2853)
atgatccgatacagcacccagccgcgacggctgcgggtgtccgcgctggcggccgtggccaacccgtcgtacgcccgggtggacacctggaacctgctcgacgacgcctgccggcacctcgccgaggtcgacctggccgggctggacaagacgcacgacgtggcccgggtgaagcgcctgctggaccgcatcgccgcctacgagcgctactggctgtaccccggcgcggagaacctggcgatcttccgcgcccacctggacagcctgtccacggtgcggctcaccgaggaggtctccctggcggtgcggctgttgagcgaatacggcgatcgcgcagggcttttcgacacgtcggcgccgctggacgaccaggagctggtggcccaggccaagcaacagcatttctacaccgtgctgctggccgacgacgcccccagcaccgcaccggacagcctggccgaatgcctgcgggcgctgcgcaacccgtccgacgacgtgcagttcgagatcctggtggtgcccagcgtcgaggacgccatcaccgcggtcgcgctgaacggggagatccaggccgcgatcatccgcgacgacctgccgctgcgctcccgcgaccggctgccgctgatgaacaccctgctcgggcccaacgaggacgcggacggcgtcatccccgaccgcgccaacgactgggtggagtgcggcgagtggatccgcgagctgcgcccgcacatcgacctgtatctgctcaccgacgaatcgatcgcggcgggcgacgacaccgaacccgacgtctacgaccgcaccttctaccggctcaacgacgtcaccgacctgcacagcacggtgctcgccgggctgcggaaccgttatgccacaccgtttttcgacgcgctgcgggcgtacgcggcggccccggtcggccagttccacgcgctgccggtggcgcgcggggccagcatcttcaactcccgctcgctgcaggacatgggggagttctacggccgcaacatcttcatggccgaaacctccaccacctccggcggcctggactcgctgctggacccgcacggcaacatcaagaaggcgatggacaaggcggccaagacctggaacgccgaccacacctacttcgtcaccaacggcacgtcgaccgccaacaagatcgtcgtgcagtcactgacccggcccggcgacatcgtgctgatcgaccgcaactgccacaagtcgcaccactacgggctggtgctggccggggcgtacccgctgtacctggacgcctatccgttgccgcagttcgcgatctacggggcggtgtcgctgcgcaccatcaagcagaccctgctggacctggaggcggccgggcagttgcaccgggtgcggatgctgctgctgaccaactgcaccttcgacggcgtggtctacaacccgctgcaggtcatgcaggaggtgctggcgatcaagccggacatctgctttttgtgggacgaggcgtggtacgcgttcgccaccgccgtgccgtgggccaggcagcgcaccgcgatggtggccgccgagcggctcgagcagatgctggcctcgccggattacgttgagcaataccggaaatgggccgcgtcgatgcagggcgtggaccgttcggagtggatcgagcgggagctgctgcccgaccccgccaccgcccgggtgcgggtctacgccacccattccacgcacaagtcgctctcggcgctgcgccaggcgtcgatgatccacgtgcgggaccaggatttcaacgcgctcacccgcgacgcgttcggtgaggcgtttttgacccacacctcgacctcgcccaaccagcagctgctggcgtcgctggatctggcccgccgccaggtcgacatcgagggcttccagctggtccggcaggtctacgacatggcgctggtgttccggcaccgggtccgcaaggaccggttgatcagcaagtggttccgcatcctcgacgagtccgacctggtgcccgaggagttccgggcgtcgtcggtgagctcctaccgcgaggttcggcagggggcgctggccgagtggaacgaggcgtggcgctccgaccagttcgtgctggacgccacccgggtcaccctgttcgtcggcgccaccggcatgaacgggtacgacttccgggagaagatcctgatggaacgcttcggcatccagatcaacaagacctcgatcaacagcgtgctgctgatcttcaccatcggcgtcacctggtccagcgtccactatctgctcgacgtgttacgaagggtggcaacggatttcgatcgcatccagaaggaggccagtgccgccgaccgggcgctgcaacgacgccacgtcgaggagatcaccgaggaccttccgcacctgcccgacttcagcgaatttgacgtcgccttccggccggtcgacgaatgcaacttcggcgacatgcggtcggcgttctacgccgggtacgaggagtccgaccgcgagcacgtgctgatcggcacggccgggcggcggctggccgagggcaagaacctggtgtcgaccaccttcgtggtgccctacccgccgggtttcccggtgctggtgcccggccaggtggtgtccaaggagatcgtctacttcctggcccagctcgacgtgaaggaaatccacggctacaacccggatttggggctgtcggtgttcaccgacaccgcgctggcgcggatggaggcgcagcgcaacgccgcgaccgccgcggtgggttcggtgaccgcggccttcgagttgcccgcggacgcctccggcggcaacggggcgcacaacggcgccggcgcggtgccgtcggtcgccgacggcggctga

SEQ ID NO: 759 - protein, 950 aa, Mycobacterium avium subsp. paratuberculosis; identical to SEQ ID NO: 405

SEQ ID NO: 760 - DNA, 1458 bp, Mycobacterium avium subsp. paratuberculosis
  CDS (1)..(1458)
atggaccaatccgacgcacctttgctcaacgcgctggccgactatcgcgacaagaaccggtacgggttcgcgccgcccgggcaccggcagggccgcggcaccgacgatcgggtcctcgcggtgctgggccgcgagccctttctcgacgacgtgctggccagcggcgggctcgacgaccgtcgcgccagcaacggctacctgcagcgcgcggaggacctgatggccgaggccgtcggcgccgagatcgcctggttctccacctgcggcagctccctgtcggtgcgcgcggcgatgatggcggtggccggtgggcagggcagcctgctggtcggccgggacagccacaagtcgatcgtggcggggctgatcttctccggggtgcagccgcgctggatcactccccgctgggacgccgagcgccacttttctcatccgccctcgccgcagcaggtcgaagaggcctgggacaagcatcccgatgccgccggtgcgctggtcgtcagccccagcccgtacggcacctgcgccgacatcgccggcatcgccgaggtgtgtcatcggcggggcaagccgttgatcctcgacgaggcgtggggggcgcatctgccgttccacgaggacctgccaacctgggcgatggatgccggcgccgacgtgtgcgtggtcagcgtgcacaagatgggcgccggtttcgagcagggctcggtgttccacgtccagggcgacctcatcgaccgggaccgcctctcggcgtgcgcggatctgctgatgaccaccagccccaacgtcctgatctacgcggcgatggatggctggcgccggcagatggtgcagcacggtcaccaattgctcggcgctgcattggatttggcgcggcaggtgcgcgacgagatcgagctcattcccgatgtggaggtgctcgacgacgagctgctgggcgtgcaggcgtcccacgacctggaccgcatgcaggtgctgatcgacgtatgcggcaccggcacatcgggttatcaggccgccgactggctgcgcgagcacgcgcgcatcgacgtgggcatgagcgaccaccgccgcatcctggccaccttgtccatggccgacgacaaggagacgttgggtcgtctcaccgatgcgctgcgggcgtggcgcaccgcggcgcaggacttcgaccccgccccccggatcgcgctgccgtcgccgtccgaaatgcagttggagacggtcgaattgccacgcgacgcgtttttcggacgggtgcaggaggtgccgaccaaaaccgccgccggccggatcgccgccgaacagatcacgccctatcccccgggcatccccgccgtcgtccccggcgagcggctcaatgatgctgtgctggactacctttgctccggggtggccgcggggatgaacctgcccgacgcggccgatccgtcgctgcagaccatccgggtgctcgcctga

SEQ ID NO: 761 - protein, 485 aa, Mycobacterium avium subsp. paratuberculosis; identical to SEQ ID NO: 407

SEQ ID NO: 762 - DNA, 2100 bp, Lactobacillus johnsonii
  CDS (1)..(2100)
atgaattttctaaaaattgcattaagcaatcaacttaaaaataatgattttaattcatggcaaactactaatttgaacgatgaaactcaagctagtgaacttgccgctattgttgtagcagagactgataaaagtagtcttaaaactgctcaagatttacaaaaaaaatcagggcttggaattcctattattaaagtttcacatgaaacaatttctaataatgaaaaaaatcaaataattgatgccgcaaatcaatacacagcagaaatggttcctggctttttaactgatttggtcaatttcgcagaagatcgtccaattagttttacgacaccaggtcatcataatggcttatattacgaaaaacatccggcgggggtagtatttaatcgcttctttggtaaaaacctcatgtttgcggataccagtgatacagtaccagaattaggcgatactatgacccacgaagggacgcctttaactgctgagcaaaaagctgccgaaacttatcatgctgataaagtttatttctgtactaatggaacaacgagtgcaaattcaatttgtgcaagtgcactattaactaaagatgacctagttctttttgatcgaaataatcataaatccctctataacagtgccttagtaatgactggtgccaaacctgtatatattccaactgatcgtaatgcacttggattaattggagaaatggatcctgactttttaaatgaagaaaaaattcgagctgaaattgctaaagttgaccctgaaaaagctaaagctaagcgtccatttagactagctatcattcaatcagaaacatatgatggtcttttttacgacgcgaagtggatgattgataaaattggtaaactatgcgattacattctttttgattgtgcttggggtggattcgaacagtttgttccaattatgaatcacctgtctcccctcaacttagactttgggtcagaagatccgggtattttagtaactcaatcacttcataaacaacaagccggaatgggccaagcctcacaaattttgaaaaaggatgctcatattaaaggtcagaaacgttacgttgatcataagcactttaaccacgcttatcttaaatttgttacctcaagttactcttatccactttatgcctcactcaccgttaactcatatttaaccagcggtgagggtaataaaaaatggtgggaccaaatcttacgcttaggaattgaatggcggaaagaattaattaaaaaatcaaaattatttaagccactagtaattgataattttgaaaatattagtactgatgagttagctacaaatgaaaagtactggaatttagattccactaatctgtggcatggatttagcaaaattgcgtctggtcaggccatgatcgatcctctaaaaattactgttgtaactcccggaattgatgttaaaaatgcaaaatatgaagaaataggtattcctggaccagttgttgcagaatttttaatggagaagcggattattcgtgcaaaagatgacctatattctcttcttttcttattaacgccgggagatactaaggctgaattagatatcttgctgaatgcattcttagaatttgaacaatattataacgaggatgcacctctagacaaagtgctccctaagctaactaaagtatacggcgatcgctacaaaggttataccttaaaacagctctgccaagaaatgcatgaatattaccggggaaataatacctttaccctccagcaagaattatttgcgaaaccagatatgcaaaattatcaaatgactcccgagcatgctgactatctctttatgaaaaatgaaagtgaattagttaacttagaagatgttaaaggtcgcattgctgctgaaggtgccttaccttacccaccaggcgtgttcattgttgcgcccggcgaaaaatggagcgatattgatcaaaaatattttgaagttttagtaggtgctatcgagcgtttcccaggctttgtacctgaaattcagggagtctactgggatcaaaaatcagatggtaaaataagagtacaagcagaagtattaaaggagaattag

SEQ ID NO: 763 - protein, 699 aa, Lactobacillus johnsonii; identical to SEQ ID NO: 409

SEQ ID NO: 764 - DNA, 1380 bp, Listeria innocua; identical to SEQ ID NO: 282
  CDS (1)..(1380)

SEQ ID NO: 765 - protein, 459 aa, Listeria innocua; identical to SEQ ID NO: 283

SEQ ID NO: 766 - DNA, 2268 bp, Escherichia coli; identical to SEQ ID NO: 410
  CDS (1)..(2268)

SEQ ID NO: 767 - protein, 755 aa, Escherichia coli; identical to SEQ ID NO: 411

SEQ ID NO: 768 - DNA, 1380 bp, Listeria monocytogenes; identical to SEQ ID NO: 284
  CDS (1)..(1380)

SEQ ID NO: 769 - protein, 459 aa, Listeria monocytogenes; identical to SEQ ID NO: 285

SEQ ID NO: 770 - DNA, 2307 bp, Yersinia pestis; identical to SEQ ID NO: 302
  CDS (1)..(2307)

SEQ ID NO: 771 - protein, 768 aa, Yersinia pestis; identical to SEQ ID NO: 303

SEQ ID NO: 772 - DNA, 2145 bp, Salmonella enterica subsp. enterica serovar Typhi; identical to SEQ ID NO: 304
  CDS (1)..(2145)

SEQ ID NO: 773 - protein, 714 aa, Salmonella enterica subsp. enterica serovar Typhi; identical to SEQ ID NO: 305

SEQ ID NO: 774 - DNA, 1467 bp, Nostoc sp. PCC 7120
  CDS (1)..(1467)
atgcttgatcaaaaccaaacaccactaatagaatctataaaagcttgtactgctcgacatcatgcagcgttttatactcctgggcataagcaggggagggggattgctcaacctttggctgatttgttgggtaaagcggtatttagtgctgatttgacggagttggctgatttagataatttatctgcgccccaaggagtgattcaggaagcccaacaattagcggcggcggcgtttggtgcctcacagacatggtttttggtcaatggttctacttgcggtgtcgaggcggcaattctggctacttgtagaccgggggataaaattattttgcctcggaatgtacattcatcggcgatcgctggtttaattctctctggtgctatcccgatttttatttatcctgaatatgacccagttttagatatcgcccatagcatcacgcctgaggctgtaaaagcagctttgcaacaacatcctgatgctaaagcggtgttgacagtttaccctacatattacggtgtatgtggggatttagaggcgatcgcccaagtcacccaccactacaatattcctttactagtagatgaagcccacggcgcacacttcgcttttcacccagaattacccacctcggccttagccgcaggtgcagatttaactgtacagtcgattcacaaggtactgggtgcaatgacgcaagcttcaatgcttcacatccaaggtgacagaataaatgcggttcgagttagtcaggctttgcagctgctacagtctactagccccagttatgtacttctagcttccctggatgcggctcgtcaacaaatggctttgtctggtaaacagttaatgtcccgtaccttacaactagcgaatgaagccagagaaagaattagtcaaattcctggcttatcagttttacagcctcctaccaagacaccatcaccagggtttacaactttggataaaacacgcttaactgtgactgtttccggcttgggtttaacgggttttgcggcggaagaaattttagatgaacaactgggggtaacggctgaatttgctacgttgcaacatctcacctttattattagcttgggaaacacagctactgatattgagcagttagtccaaggtttcacaactttagcagaaacaacactgcctactaaggcattagtcaacccaaaagttaatagtaatctggaatatttttcagaaatttctccccgtgatgccttttttgccgatagtgaaacgttatccatcgaacaggcgtgcgatggcatttgtgcagaaattgtctgtccttatcccccaggaatccccgtccttatgccaggagaagttatcacaaaacccgccattgaatatttgcaacatatccaaagtttaggcggattcattactggttgtgccgatactagtctgaatactttaaaagttttagtcaatagtcattag

SEQ ID NO: 775 - protein, 488 aa, Nostoc sp. PCC 7120; identical to SEQ ID NO: 287

SEQ ID NO: 776 - DNA, 2163 bp, Yersinia pestis
  CDS (1)..(2163)
atgacactattaaaaatagcaacaagcgcccgcctggcttcttatgtagaaactcagcgcggagtggtgtacctcaatcagactgactttactgatgttgccgcggtggtaatgtcggttgaagatgcaaatgcgggtatattgtcaatgctgcatgaccttggttttgctattcctgcgtttattgccgtgacggcagaacagacggtctctgctgattatttgcccttgattaaaggtgtcattacgcttggtgaagcaaataaagctttttataacgctcaggtagaagctgccgccagtgaatatcaaaagaatctcttaccgccttttttctcaacactgaaaaaatatgtcgagatgaataactcgacctttgcttgccctggccatcaggggggcgaattttttcgcaagcatcctgcaggacgccagttttttgaattctacggtgagacgatttttcgttcagatatgtgtaatgccgatgtcaaattaggtgatttacttatccatgaaggggcggcaaaagatgcacagaaatatgctgctaaggtattcaatgccgataaaacctattttgtcctgaacggtacctcggcggccaacaaggtcgtgaccaacgctttactgacccgtggtgatttagtgttgtttgaccgcaataaccataaatctaaccatcatggtgcgctgatccaggcgggcgcgacgccggtttatctggaaacggcccgtaacccctttggttttattggtggtattgatgcgcactgcttcaatgaagattatttacgtcaacaactgcgtgaagttgctcccgagcgtgcagaagaggctcggccattccgattagcgatcattcaattgggtacctacgacggtacggtatataacgcccgccaagtagttgatagtattggtcatttatgcgattacattttgtttgattctgcttgggtgggttacgaacaatttattccgatgatgaaggatttctcaccgttattactggaattaaatgaaaatgaccctgggattattgtgactcaatcggtacacaagcagcaggccggtttttctcagacctctcaggtacataaaaaagataatcacattaaaggacagaaacgtcactgtaaccataagcgttttaataatgcctttatgttgcatgcatcgaccagtccgttttatccattatttgcggcattggatgttaatgccaaaatacactctggtgacagtggccgccgtatgtggatggattgtgtaaaactcggtattgaaacccgtaaatcgttattggcacgctgttcgatgttacggccttttattcctccagttgttggcggtaaaaattggcaagattatgctactgatgtgattgccaatgatgcgcgcttctttaattttgtcccagatgaacgctggcatggatttgagggatataaccaagatcagtatttggttgatccgtgcaaattattgctgacgacgccgggaattgatgccagtactggccgatatacttcgtttggtattccggcggctattttggcgactttcctgcgtgaaaatggaattgtgccagaaaaatgtgatcttaactcgatcctattcctgctgaccccggcagaaaataccgccaaaatggcacacctggtggatatgttggtgcagtttgaacgctatgttgaacaagatgcgaagctgtgtgatgtattaccgacgatctatcgtaagaatgaagagcgttatcacggttataccttgcgtcagttatgccaagaaatgcatgacctgtacgtcagccatgacgttaagcaattgcaaaaggatatgttccgtaaagccagtttcccgcaggtagtcatgaacccgcaagacgccaatattcagtttatccgcgataatattgagttgattcctattgctgaagctgaaggccgtattgccgccgaaggcgctttgccttatccaccgggtgtgctgtgtgtggtgcccggtgaagtgtggggtggggcggttcagcgttattttctggcgctggaagaggggattaacttactgccgggcttttcacctgagttacagggcgtttatatcgaaaaaggtgatgtgtcttggcggcgtatctttggttatgtgattacgcaatag

SEQ ID NO: 777 - protein, 720 aa, Yersinia pestis; identical to SEQ ID NO: 307

SEQ ID NO: 778 - DNA, 2271 bp, Salmonella enterica subsp. enterica serovar Typhi; identical to SEQ ID NO: 308
  CDS (1)..(2271)

SEQ ID NO: 779 - protein, 756 aa, Salmonella enterica subsp. enterica serovar Typhi; identical to SEQ ID NO: 309

SEQ ID NO: 780 - DNA, 2148 bp, Escherichia coli
  CDS (1)..(2148)
atgaacgttattgcaatattgaatcacatgggggtttattttaaagaagaacccatccgtgaacttcatcgcgcgcttgaacgtctgaacttccagattgtttacccgaacgaccgtgacgacttattaaaactgatcgaaaacaatgcgcgtctgtgcggcgttatttttgactgggataaatataatctcgagctgtgcgaagaaattagcaaaatgaacgagaacctgccgttgtacgcgttcgctaatacgtattccactctcgatgtaagcctgaatgacctgcgtttacagattagcttctttgaatatgcgctgggtgctgctgaagatattgctaataagatcaagcagaccactgacgaatatatcaacactattctgcctccgctgactaaagcactgtttaaatatgttcgtgaaggtaaatatactttctgtactcctggtcacatgggcggtactgcattccagaaaagcccggtaggtagcctgttctatgatttctttggtccgaataccatgaaatctgatatttccatttcagtatctgaactgggttctctgctggatcacagtggtccacacaaagaagcagaacagtatatcgctcgcgtctttaacgcagaccgcagctacatggtgaccaacggtacttccactgcgaacaaaattgttggtatgtactctgctccagcaggcagcaccattctgattgaccgtaactgccacaaatcgctgacccacctgatgatgatgagcgatgttacgccaatctatttccgcccgacccgtaacgcttacggtattcttggtggtatcccacagagtgaattccagcacgctaccattgctaagcgcgtgaaagaaacaccaaacgcaacctggccggtacatgctgtaattaccaactctacctatgatggtctgctgtacaacaccgacttcatcaagaaaacactggatgtgaaatccatccactttgactccgcgtgggtgccttacaccaacttctcaccgatttacgaaggtaaatgcggtatgagcggtggccgtgtagaagggaaagtgatttacgaaacccagtccactcacaaactgctggcggcgttctctcaggcttccatgatccacgttaaaggtgacgtaaacgaagaaacctttaacgaagcctacatgatgcacaccaccacttctccgcactacggtatcgtggcgtccactgaaaccgctgcggcgatgatgaaaggcaatgcaggtaagcgtctgatcaacggttctattgaacgtgcgatcaaattccgtaaagagatcaaacgtctgagaacggaatctgatggctggttctttgatgtatggcagccggatcatatcgatacgactgaatgctggccgctgcgttctgacagcacctggcacggcttcaaaaacatcgataacgagcacatgtatcttgacccgatcaaagtcaccctgctgactccggggatggaaaaagacggcaccatgagcgactttggtattccggccagcatcgtggcgaaatacctcgacgaacatggcatcgttgttgagaaaaccggtccgtataacctgctgttcctgttcagcatcggtatcgataagaccaaagcactgagcctgctgcgtgctctgactgactttaaacgtgcgttcgacctgaacctgcgtgtgaaaaacatgctgccgtctctgtatcgtgaagatcctgaattctatgaaaacatgcgtattcaggaactggctcagaatatccacaaactgattgttcaccacaatctgccggatctgatgtatcgcgcatttgaagtgctgccgacgatggtaatgactccgtatgctgcattccagaaagagctgcacggtatgaccgaagaagtttacctcgacgaaatggtaggtcgtattaacgccaatatgatccttccgtacccgccgggagttcctctggtaatgccgggtgaaatgatcaccgaagaaagccgtccggttctggagttcctgcagatgctgtgtgaaatcggcgctcactatccgggctttgaaaccgatattcacggtgcataccgtcaggctgatggccgctataccgttaaggtattgaaagaagaaagcaaaaaatag

SEQ ID NO: 781 - protein, 715 aa, Escherichia coli; identical to SEQ ID NO: 293

SEQ ID NO: 782 - DNA, 1548 bp, Pseudomonas aeruginosa
  CDS (1)..(1548)
atgtctcgaaacaatccttcgcgtcattcaatactcgtcacttccaacataaacgcggccaatgatgcgaatcgtctttccgagctttgtcgacaactggaaatacgcggctatcggctcttccaggcgccaagccgcaaggtcgccctggattttctcggcaacgccgcgcaccccgccggcatcctcctgctcgtcgcggagccgacaggcgagaacgaggccgcacaattggcggccctcgatgaactccgccaggtcgcgccgtccatcccgctgttcctgttgtttcgtcaactgcgcatcgagcagttgtccagccagctactggacgaggcccagggatgcttcaacctggccgccggccccgcacgcttcatcgccgagcgcatcgacagcgacctgcgcgaatggcgcgccccggcaggccccaggcggctgcgcgactatgccccgccggtcccgcgcacgccggtgagcgcccgctacaacggccgcgcacgcctcgacttggcgccggccaagcagtggcggatcggctcggggagcaccgcggagcgcctggcgacaccgctgaacgacctctccacggcctaccgcaagacgtccgcaggagccccggcggcgcacgccggcgacatcgccgaggcctttcgccgggcgctctgggaagccgctgcgcggctcgccagggaggatggcgatacgtggttcttcgagatactgcggggcaacccggggcctggcatcgaggccggccgggagacgccggcgaagcgctggcacgggctcgccgagacactcgacagcagtcctcggctggacccgctgcgcgtcgccctgagcgcccccggcctcgattcgcgcggtcgcccggccagcttcggagtacccgccgcggtggtctgccgctacctgcgccggcacggcatcgccccgttgcgcaccggcgactatcgcttcctgctgctgtttccccagggcgccagggcggaacacgcgcagccgctggtggacaggctgtgcgaattcaaacgccggcacgacgacgatgcgccgctgaagcaggtgttgccggagttgctcgacagctcgccgctgtaccgctacatcggcctgcgcgaactctgcgcgatgatccacgaagccagcctgcggctgcacctgaccgccctcgccgacgccgccgccagggctgccggccacgccgcgctggcgccggccacggtctatgggcacctggtcagggacgaaaccgaagcggtggcgatcgacaggctcggcggccgtgtggtcgccagcctggtcggcgtccatccggcggccacgccgctgctgttgcccggcgaacgggtggccgaggaatcaccggcgctgatcgactacctgctggccttgcaggccttcggcgagcactttcccggtttcgctcccgagttgcagggcatcgagatcgatgagcgcggccgctaccgggtccgttgcgtcaggccggcagccctcgcccgcggctccggcctgcgcctggccacgcgccggccggactga

SEQ ID NO: 783 - protein, 515 aa, Pseudomonas aeruginosa; identical to SEQ ID NO: 323

SEQ ID NO: 784 - DNA, 2175 bp, Vibrio parahaemolyticus; identical to SEQ ID NO: 400
  CDS (1)..(2175)

SEQ ID NO: 785 - protein, 724 aa, Vibrio parahaemolyticus; identical to SEQ ID NO: 401

SEQ ID NO: 786 - DNA, 1446 bp, Clostridium acetobutylicum
  CDS (1)..(1446)
atgtctaagacaccaatcatagatggaataatgaaatatataagtgaaaagaataatctgttttgcactccagggcataagggaggcagaggattcgcaaatagcgaaggtggcagaagcttatatgaaaatatcataaagatagatttaacagaagttgatggacttgataacttacatgatcctcaaggaattatcaaggaatcagaagagagacttagagatttatatgaaagtaaaaaatcatattttcttgttaacggaagtacaagtggtaatctcgctatgatattttcatgttttaatgagggagacaaggtaatagttgaaagaaattgccataaatctatatttaatggaattatacttaggaagcttaatcctgtgtatataaaaaattactttgacgaggatataaatgctcctttatctatagatgaggagtattttttcaagattataagagaaaatatggatgcaaaagggataatacttacatatcctaattactatggagtatgctgtgaccttgaagctatagtgagagaggcaaaaaaatataatatgaaggtattagttgactctgctcatggcgctcattttggtatatcagagaagttaccagaaagtgctgttaagttaggagcagatatggttgttatgagttgtcataaaacgcttccgagtttcacacaaactgcatttcttcatttatgtggagatgtcgaggaaagcaaagttgatttttatgtaagttcatttttgagtacaagcccatcgtatatgtttatgagctcaatggattatgctagatgctatcttgaggaaagaggaaagcatgattatgataacctggtagatttatgtataaagtattcaaaaaagattaatgaaatcaatggattgcatgtattaggtaagagtgatttaaggataaatggtaaggtgcttaattttgatgcaacaagattagttatcaatgtagaggatggttgcagtgggtttaaattatatacgtatttaaaagaaaatagaatacaacctgaaatgtgcgatcatagaaatgttgttttaatttgttcaccatttgacggagaattgcagttacaaaacttatataatacacttagaaaatgcaatattataaaattaaatgacgataataaggtatctgtgcttttgtcatctatgccagaaaataaatttgccccgtatgaggtattgaatttagaaagtgaaaagatcaatattaaagatagtgtgggaaaagtgtgtaaaaaagcattagtgccatatccacctggaataccggtgattatgccaggagaagtaataaatgaaaatgttgttgatattatattgaaagctgttaaagataacattacagttttaggaattgaaaatcgaaataaagaaattaccatagatgtagtttgtgaagattaa

SEQ ID NO: 787 - protein, 481 aa, Clostridium acetobutylicum; identical to SEQ ID NO: 277

SEQ ID NO: 788 - DNA, 1464 bp, Clostridium acetobutylicum; identical to SEQ ID NO: 278
  CDS (1)..(1464)

SEQ ID NO: 789 - protein, 487 aa, Clostridium acetobutylicum; identical to SEQ ID NO: 279

SEQ ID NO: 790 - DNA, 2358 bp, Rhodopseudomonas palustris; identical to SEQ ID NO: 402
  CDS (1)..(2358)

SEQ ID NO: 791 - protein, 785 aa, Rhodopseudomonas palustris; identical to SEQ ID NO: 403

SEQ ID NO: 792 - DNA, 2256 bp, Pseudomonas aeruginosa
  CDS (1)..(2256)
atgtataaagacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactgatccgcgtggcccgcgtgcgggcgccgcaattgccgatcttcgccctcggcgagcaggtgaccatcgagaacgcgccggccgagtccatggccgacctgcaccagttgcgcggcatcctctacctgttcgaagacaccgtgccgttcctcgcccgccaggtcgcccgggcggcgcgcaactacctggccgggctgctgccgccattcttccgtgcgctggtcgagcacaccgcgcagtccaactattcctggcatacgccgggccacggcggcggtgtcgcctatcgcaagagtccggtgggacaggcgttccaccagttcttcggggagaacacgctgcgttccgacctgtcggtctcggtccccgagctgggatcgctgctcgaccataccggccccctggccgaggccgaggaccgtgccgcgcgcaatttcggcgccgaccataccttcttcgtgatcaatggcacttccaccgcgaacaagatcgtctggcactccatggtcggtcgcgaagacctggtgctggtggaccgcaactgccacaagtcgatcctccactcgatcatcatgaccggggcgataccgctctacctgactccggaacgcaacgaactggggatcatcgggccgatcccgctgagcgaattcagcaagcagtcgatcgccgcgaagatcgccgccagcccgctggcgcgcggccgcgagccgaaggtgaagctggcggtggtgactaactccacctacgacggcctgtgctacaacgccgagctgatcaagcagaccctcggcgacagcgtcgaggtgttgcacttcgacgaggcttggtacgcctatgccgcgttccacgagttctacgacggacgctatggcatgggcacctcgcgcagcgaggagggacccctggtgttcgccacccactccacgcacaagatgctcgccgccttcagccaggcctcgatgatccacgtgcaggatggcgggacccggaagctggacgtggcgcgcttcaacgaagccttcatgatgcacatctcgacctcgccgcagtacggcatcatcgcttcgctggacgtggcttcggcgatgatggaagggcccgccgggcgttcgctgatccaggagaccttcgacgaggccctcagcttccgccgggccctggccaacgtacggcagaacctggaccggaacgactggtggttcggcgtctggcagccggagcaggtggagggcaccgaccaggtcggcacccatgactgggtgctggagccgagcgccgactggcacggcttcggcgatatcgccgaagactacgtgctgctcgacccgatcaaggtcaccctgaccaccccgggcctgagcgctggcggcaagctcagcgagcaggggattccggccgccatcgtcagccgcttcctctgggagcgcgggctggtggtggagaaaaccggtctctactccttcctggtgctgttctcgatgggcatcaccaagggcaagtggagcaccctggtcaccgaactgctcgaattcaagcgctgttacgacgccaacctgccgctgcttgacgtcttgccctccgtggcccaggccggcggcaagcgctacaacggagtgggcctgcgcgacctcagcgacgccatgcacgccagctaccgcgacaacgccacggcgaaggccatgaagcgcatgtacacggtgctgccggaggtcgcgatgcggccgtccgaggcctacgacaagctggtgcgcggcgaggtcgaggcggtaccgatcgctcggttggaagggcgcatcgcggccgtcatgctggtaccctatccgccgggtatcccgctgatcatgccgggtgagcgcttcaccgaggcgacccgctcgatcctcgactatctcgagttcgcgcggaccttcgagcgcgccttccctggtttcgactccgatgtgcatggcctgcagcatcaggacggaccgtccgggcgctgctataccgttgaatgcataaaggaatga

SEQ ID NO: 793 - protein, 751 aa, Pseudomonas aeruginosa; identical to SEQ ID NO: 311

SEQ ID NO: 794 - DNA, 2853 bp, Mycobacterium leprae
  CDS (1)..(2853)
atgaatcgagacagtggccatccgcgacgacttcgtgtttccgcgctggcggcagtagccaacccgtcatacacgcgcattgacacgtggaacgtgctcgatgacgcctgccgtcacttggctgaggtcgaccgcgccgggctggacaccgcccacgatgttgcgcgtgttaagcgtttgctcgaccgcatcggtgcctacgaacggtactggctgtaccctggtgcggcaaatctggcggcgttccgcggctatcttgccaccatggcgacggttcagcttaccgaagaggtatcgctggccgtccgtctgttgtctgaatatggtgaccgcacagcgctttttgatacttcagcgccgctggccgaccaggagctggtggcccaagccaagcagcaacagttctacaccgtgttgctcgccgacgatgccccatccacggctcccgactgtctggcagagagcttgcgggagctgcgcaatccatccgacgatgtgcagttcgagctccttgttgtgtccagtgttgaggacgccatcaccgcggtcgcgctgaacggcgagattcaggctgcgatcatccgccatgacctgccactgcggtcccgcgaccgggtgccgttgatgaataccttgcttggggccaacgactcggagggcgcactggtcaccattgaccgcccacacgactgggtcgaatgcggtgagtggatcagggagctgcggccccatatcgacctctatctgctcaccgacgagtcgatcgcggcgggcaatgatgacgagcccgatgtctacgaccggacgttttatcgactcaacgacgttaccgacctaaacagcaccgtacttgcaggcttgcgaaaccgtttcgccacaccatttttcgatgccttgcgcgcctacgcagcagcaccggtcggccaattccatgctcttccggtcgcgcgtggtgccagtatctttaactctaggtcgctgcaagacatgggcgagttctacggtcggaacatcttcatggccgagacatcgaccacctctggtggcctggattcgttgctggatccgcacggcaacatcaaaaaagcgatggacaaagccgcagttacttggcgcgccaaccacacctactttgtcaccaacggaacttccacagccaacaaaatcgtcgtacagtcgttgacccggccaggtgacattgtacttatagaccgcaactgccacaagtcgcaccattatggcctggtattggctggtgcatacccgatgtacttggatgcttatccgttgccgcagttcgcgatctatggagcggtatcgctgcgcacaatcaagaaggcgctgctggatctagaggcagtccgacaactggatcgggtccgcatgttgttgctcaccaactgcacttttgatggcgtcgtctgtaacccgcagcgggtaatggaggaggtgctggcgatcaagccagacatttgcttcctatgggacgaggcgtggtatgcgtttgccactgccgtgccgtgggctcgtcagcggaccgcaatggtgtctgctgagcaactcgaacagaagttgtggtctgtcgaatacgccgaggaatatcggaattggtgcgcatcgatggccgagatccctcggtcccagtgggttgaccagcggctactgccggaccccaatcgggcgcggattcgcgtatatgcgacacactctactcacaagtcgctgtcggcgcttcggcaggcgtcgatgattcatgtccgcgatcaagatttcaatgcgctagcccgggatgcgttcggtgaggcattcttgacgcacacctcgacatcgccgaaccaacaacttctcgcgtcgttggatctggcgcgccgccaggttgacatcgagggatttcaactggtccggctggtgtacgacatggcgctggtctttcgtcaccgcgtccgcaaagaccggctgatcagcaaatggttccgtatcctcgatgaatccgacctggtgcccgacgagtaccgggcatcggcggtcagctcgtaccgtcaggttcggcagggtgctctggcggagtggaatgaggcatggcggtccgaccagttcgtgctggatccgacgagggtcaccttgttcgtcgggaagaccggaatgaacggatatgacttccgcgagaagatcttgatggagcgattcggcatacagatcaacaagacatccatcaacagtgtgctgttgatcttcaccatcggtgtcacgtggtcgagcgtgcattatctgctagatgtgttacgccgggtggccagtgactttgacaggattcagaaggtggccagcggggccgacctcgcgctgcatcagcgccatgttgaggagatcacccaggatttgccccacttgcccgacttcagcgagttcgatgttgccttccgtcccgaaaatgccagctcgttcggtgacatgcggtcggccttctacgccgggtacgaagaatcggaccgcgagtacgtgcatatcggcacggccgggcgtcagcttgctgaggggaggaccctggtgtccaccacgttcgtggtgccctacccgcccggcttcccggtactagtccctggtcaggtggtttctaaggagataatctacttcttggctcagctcgacgtgaaggaaattcacggatacaaccatgaactgggattatcagtattcactgagaaagcgttggctcggatgatcgcgaggcgcaacgcggcgtcggccgcggtgggttctgcgttcgcggctttcgagatcccatcggactctgctgctatgggcggggacgtgaacggcgacagagtcgaggctgttgcagaagacgcgtga

SEQ ID NO: 795 - protein, 950 aa, Mycobacterium leprae; identical to SEQ ID NO: 319

SEQ ID NO: 796 - DNA, 2196 bp, Escherichia coli
  CDS (1)..(2196)
atggggcagggttttccaccttgtccggtattcttacttccccgaaacgggtttgcgcttatgaaatcaatgaatattgccgccagtagtgaactggtatcccgactttcttctcatcgtcgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttttttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcgggggcgacgccggtctatctggaagcttcacgcaacccgtttggtttcattggcggtattgatgcgcactgttttaatgaagagtatctgcgccagcaaattcgcgacgttgcgccagaaaaagccgacctgccgcgcccgtatcgcctggcgattattcagctgggaacctatgacggcactgtctataacgcccgtcaggtgatcgataccgttgggcatctgtgtgattacattctgtttgattccgcgtgggtcggttatgaacaatttatcccgatgatggcggatagctcgccgctgctgttagaacttaacgaaaacgatccggggatctttgtgactcagtcggtgcacaaacagcaggcgggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgtgttgagatagggattgaagcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcgatgccgaaaccggcgaatatagcgactttggcgttccggcgacgattctggcgcactatctgcgtgagaacggcattgtgccggagaagtgcgatctcaactccattctgtttttattaactccggcggaaagccacgagaagctggcacaactggtggcgatgctggcgcaatttgaacagcatattgaggatgactcgccgctggttgaggtgttgccgagcgtttataacaagtatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgacgtggagttggtgcggattcgtgatgccgaagggcgaattgcggcagaaggggcgttgccttatccacctggcgtgctttgcgtggtacccggggaagtctggggtggggcggttcaacgttatttccttgcactggaagaaggggtgaatttgttgccgggattttcgccggagctgcaaggtgtttatagcgaaaccgatgcggatggcgtgaaacggttgtacggttatgtgttgaagtaa

SEQ ID NO: 797 - protein, 731 aa, Escherichia coli
MGQGFPPCPVFLLPRNGFALMKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGATPVYLEASRNPFGFIGGIDAHCFNEEYLRQQIRDVAPEKADLPRPYRLAIIQLGTYDGTVYNARQVIDTVGHLCDYILFDSAWVGYEQFIPMMADSSPLLLELNENDPGIFVTQSVHKQQAGFSQTSQIHKKDNHIRGQARFCPHKRLNNAFMLHASTSPFYPLFAALDVNAKIHEGESGRRLWAECVEIGIEARKAILARCKLFRPFIPPVVDGKLWQDYPTSVLASDRRFFSFEPGAKWHGFEGYAADQYFVDPCKLLLTTPGIDAETGEYSDFGVPATILAHYLRENGIVPEKCDLNSILFLLTPAESHEKLAQLVAMLAQFEQHIEDDSPLVEVLPSVYNKYPVRYRDYTLRQLCQEMHDLYVSFDVKDLQKAMFRQQSFPSVVMNPQDAHSAYIRGDVELVRIRDAEGRIAAEGALPYPPGVLCVVPGEVWGGAVQRYFLALEEGVNLLPGFSPELQGVYSETDADGVKRLYGYVLK

SEQ ID NO: 798 - DNA, 2196 bp, Lactobacillus sp. (strain 30a); identical to SEQ ID NO: 414
  CDS (1)..(2196)

SEQ ID NO: 799 - protein, 731 aa, Lactobacillus sp. (strain 30a); identical to SEQ ID NO: 415

SEQ ID NO: 800 - DNA, 2202 bp, Vibrio cholerae; identical to SEQ ID NO: 312
  CDS (1)..(2202)

SEQ ID NO: 801 - protein, 733 aa, Vibrio cholerae; identical to SEQ ID NO: 313

SEQ ID NO: 802 - DNA, 2163 bp, Vibrio cholerae; identical to SEQ ID NO: 314
  CDS (1)..(2163)

SEQ ID NO: 803 - protein, 720 aa, Vibrio cholerae; identical to SEQ ID NO: 315

SEQ ID NO: 804 - DNA, 2163 bp, Haemophilus influenzae; identical to SEQ ID NO: 294
  CDS (1)..(2163)

SEQ ID NO: 805 - protein, 720 aa, Haemophilus influenzae; identical to SEQ ID NO: 295

SEQ ID NO: 806 - DNA, 2844 bp, Mycobacterium tuberculosis
  CDS (1)..(2844)
atgaacccaaacagcgtccgcccgcgacggctgcatgtctccgcgctggccgcggtggccaacccgtcctacacccgcctggacacctggaacctgctcgatgacgcgtgtcgtcacctggcggaggtcgacctcgccgggctcgacaccacacacgacgtggctcgggcgaagcggctgatggaccgcatcggcgcctatgagcggtactggctgtatccgggggcacagaatctggcgactttccgcgctcatctggatagtcattccacggtgcggcttaccgaggaagtgtcgttggccgtacgactgctgtccgaatacggcgaccgcacagcgctgttcgacacctccgcgtcactggcggagcaggagctggtagcgcaggccaaacagcagcagttctacaccgtgctgctcgccgacgactccccggcgacggctccggacagcttggccgagtgcctgcggcagttgcgcaatccggccgacgaggtgcagttcgagttgctcgtggtggccagcatcgaagatgccatcaccgcggtggcgctgaatggcgagattcaggcggcgatcatccgtcacgacctgccgctgcggtcccgcgaccgggtgccgctgatgaccacgctgctgggcaccgatggcgacgaagcggtggcaaacgagacccacgactgggtggaatgcgccgagtggatccgtgagttgcggccccacatcgacctctatctgctcaccgacgagtcgatcgccgccgagacccaggacgagcccgacgtctacgaccgcaccttctaccggctcaacgacgtcaccgacctgcacagcacggtgctcgcgggtttacgaaaccgttatgccacaccgtttttcgatgcgctgcgggcctatgcggcggcgccggtcggccaatttcatgcccttcccgtcgcgcgcggcgccagcatcttcaactccaagtcactgcacgacatgggcgagttctacggccgcaacatcttcatggccgagacctcgacaacctctggtggactggactcgctgctggacccgcatggcaacatcaagacggcgatggacaaagccgcggtgacctggaacgccaaccagacctacttcgtcaccaacggaacatcgaccgccaacaagatcgtcgtgcaggccctgacccgccccggcgacatcgtgctcatcgaccgcaattgccacaagtcgcaccactacggcctggtacttgccggcgcgtacccgatgtacctcgacgcatatccgctgccgcagtacgcgatttatggtgccgtgccgttgcgcaccatcaagcaggcgctgctggacctcgaggccgccggacagctgcaccgggtgcgcatgctgttgctcaccaactgcacgtttgacggcgtggtgtacaacccgcgccgggtgatggaggaggtgctagcgatcaaaccggacatctgctttttgtgggacgaggcgtggtatgcgtttgcgacggcggtgccctgggcccggcagcggaccgcgatgattgctgccgagcgactcgagcagatgttgtccactgcggaatacgctgaggaataccggaattggtgtgcgtcgatggacggagtggaccgctccgagtgggttgatcaccggctgttgccagaccccaaccgcgctcgggtccgagtgtatgcgacgcattcgactcacaagtcgctgtccgcgctacggcaggcatcgatgatccacgtgcgcgaccaggatttcaaagcgctcacccgggacgcgttcggtgaggcattcttgacccacacctcgacctcgcccaaccagcaacttctcgcctcgttggacttggcgcgccgacaggttgacatcgaagggttcgagctggtccgccatgtttacaacatggcgctggtgttccgccatcgcgtccgcaaagaccggctgatcagcaagtggttccgcatccttgacgagtccgacctggttcccgatgcctttcggtcctcgacggtcagctcgtaccgtcaggtcaggcagggggctctggccgattggaacgaagcctggcggtccgatcaattcgtgctcgatccgacgcggctcaccctgtttatcggggcgaccgggatgaacgggtacgacttccgcgagaagatcctgatggagcgattcggcatccagatcaacaaaacgtctatcaacagcgtgttgctgatcttcacgatcggcgtcacctggtcgagcgtgcactatctgctcgatgtgttgcgtcgggtggcgatcgatctggaccgcagccagaaggcggccagcggggccgaccttgctctacaccgacgccacgtcgaggagatcacgcaggatctgccgcatctaccagatttcagcgagttcgaccttgccttccgccccgacgacgccagctctttcggtgacatgcggtcggctttctacgccggctacgaagaggccgaccgtgagtacgtgcagatcggcttggccgggcgccggctggctgagggcaagactctggtatccaccacgttcgtggtgccctacccgcccggcttcccggtactggtgccgggtcaactggtttccaaggagatcatctactttcttgcccagctcgacgtcaaagagatccacggatacaaccccgacctggggttgtcggtgttcacccaggcggcattggcccggatggaggccgcgcgcaacgccgtcgccacggtaggtgccgcgctgccggccttcgaggtaccgcgggacgcttcggctttgaatggcaccgtcaacggcgacagtgtgctgcagggggtcgccgaagacgcgtga

SEQ ID NO: 807 - protein, 947 aa, Mycobacterium tuberculosis; identical to SEQ ID NO: 321

SEQ ID NO: 808 - DNA, 1476 bp, Streptococcus pneumoniae
  CDS (1)..(1476)
atgaaagagttagatcaaaaccaagccccaatttatgaggccttggtgaagttacgcaagaaaaggattgttccctttgatgttccaggtcacaagcgtggacggggaaatccagaacttgtcgaactcttaggagaaaaatgtgtaggcattgatgtcaattcgatgaaacctttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccacggagcgcatttgcatttcactgataaacttccaatttctgctatggatgcaggggctgatatggcagcagtttccatgcataagtctggtgggagtttgacccaaagctccattttacttatcggggagcagatgaattctgaatacgttcgtcagataattaacctgacccagtctacatctgcctcttacttgttgatggctagtttggatatttcacgtcgcaacttggcccttcgtggtaaagagtcgtttgagaaagtcattgagctatctgagtatgcccgccgtgaaatcaatgctatcggtggctactatgcctactcaaaagagttaatagacggtgtttcggtttgcgattttgacgtaactaagctgtcagtttacactcagggtattggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcaagagatggaaaagatttgatagcaggagaatatattcagcccgagttagtgctgtctccgcaagaagccttctattcagaaagaaaaagtttaactttggatgattctgttggacaggtctgtggagaatttgttatgtgttaccctccaggtattcctatcttggctcctggtgaacgcattacacgagaaattgtcgactatatccaattcgccaaggaacgtggttgctccctccaagggacggaagatccagaggtcaatcatatcaacgttattaagagaaagacaaactataagaaaagtcaatag

SEQ ID NO: 809 - protein, 491 aa, Streptococcus pneumoniae; identical to SEQ ID NO: 275

SEQ ID NO: 810 - DNA, 1476 bp, Bacillus halodurans; identical to SEQ ID NO: 268
  CDS (1)..(1476)

SEQ ID NO: 811 - protein, 491 aa, Bacillus halodurans; identical to SEQ ID NO: 269

SEQ ID NO: 812 - DNA, 2349 bp, Sinorhizobium meliloti; identical to SEQ ID NO: 316
  CDS (1)..(2349)

SEQ ID NO: 813 - protein, 782 aa, Sinorhizobium meliloti; identical to SEQ ID NO: 317

SEQ ID NO: 814 - DNA, 1476 bp, Streptococcus pneumoniae
  CDS (1)..(1476)
atgaaagagttagatcaaaaccaagccccaatttatgagtccttggtgaagttacgcaagaaaaggattgttccctttgatgttccaggtcacaagcgtggacggggaaatccagaacttgtcgaactcttaggagaaaaatgtgtaggcattgatgtcaattcgatgaaacccttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatatgttcagacctaaaggggttgacagaaatggctcatgaagctggcatgatggttttagtagatgaagcccatggagcgcatttgcatttcactggtaaacttccaatttctgctatggatgcaggagctgatatggcagcagtttccatgcataagtctggtgggagtttgacacaaagttcgcttcttttaatcggggagcagatgaatcccgagtacgttcgtcagattataaacctgacacagtctacatctgcctcttacttattgatggctagtttggatatttcacgtcgcaacttggcccttcgtggtaaagagtcgtttgaggaagtcattgagctatccgagtacgctcgtcatgaaatcaatgccattggcggttactatgcttactcaaaagagttaatagatggtgtgtcggtctgtgattttgatgtaaccaagttgtcagtttacactcagggaataggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcacgagatgggaaggacttaatagctggagaatatattcagcccgagttggtgctgtctccacaagaagccttctattcagagagaaaaagtttgaccttagatgagtctgttggacaggtctgtggagaatttgtcatgtgctatcctccagggattcctatcttggctcctggtgaacgcattacacgagaaattgtagactatatccaattcgccaaggaacgtggttgctccctccaagggacggaagatccagaggtcaatcatatcaacgttattaagagaaagacaaactataagaaaagtcaatag

SEQ ID NO: 815 - protein, 491 aa, Streptococcus pneumoniae; identical to SEQ ID NO: 281

SEQ ID NO: 816 - DNA, 2307 bp, Photorhabdus luminescens (subsp. laumondii)
  CDS (1)..(2307)
atgattaatttagacattaacgaacaaaacaaaattatggtcgtcagcagccatgtatttagaccgacgacggcgaatggtcgagcctttaccgagttaatagaagcattaaaaaagaacaatttcgctgttatcctggcggctacattccaagatggcatagctaccgtttcttctgattcctcactatgctgtatttttgttgattggacttcaggagataataactatgaatctcataaacaagtgttagaattactgaaagagatacgcaaacacaatacaaccattccggtattgttgaccgcggaatattccagcatcgacacactgacacttgaagtcatgggattggcagatgaatttgtctggatgcttgaagacacggctggatttatcgcctctcgcgccagttcgctaattaagaaatattatgcgcaattattaccgcctttcactcgtgcattactgcaatacactcaagaatcaccagaatattcctggactgctcctggacatcaaggcggtgttgcactgactaagacagcggcaggaagagaattaattaatttctttggggaaaatttatttcgaagtgatattggaatagaaagaaaaatacttggctcactgctagatcatacaggtgcgattaaagaatcagaagaatatgccgcaacgatttttggtgcccatcaaagctattgcgtgcttaacggcacttcgggttctaaccgtattatcatgggtgccgttattggtgagaaagagattattatatgcgatcgcaattgccataaatcgattggacaaggtttaataatgactggggctttgcccgtatatcttattcctcaacgcaaccgctatggtattattggccccattcccagagatcaatttcaaccagaatatatccaacaactcattgatcaacacccattaaaagcgatcgcaatagacaataagcctgtttatgcggtcatcaccaactgtacttatgatggaatatgttatcacgcagaacaagcacaagatttactagcaaaaagtgttgatcaaattcattttgatgaagcctggtttgcttatgcgcgttttaatcctatgtataaacatcgttactcaatgcgtgatgacccaaatgattttgacaataatggcccgacaatatttgccactcaatccacgcataagatgttagcagcgctatcacaatcatcctatatccatatccgcaatggcaaaaaacccattgaacattcccgtttcaacgagtcttatatgatgcactccacaacttcaccgctatattcgcttatcgccactaatgaaattgcagcggccatgatggatggcccacaggggcaaagactgatacaaaacgctatcaatgaagccgtagacttccgtctgacattagcaaaaacccatcatcaatttaaacaaaaagatgattggtttttcttaccctggaatgccagagagattattagcgcagatagcggtaaattaattcccttccatgaagcaaacagagaacaattagcaacggatccttcctgttgggtattaaaagagggagaaaaatggcatggatttaccaatctatcagcagaatggtgcctgctagatccaacaaaagttggtattttatgcccaggaatgaatgataatgatgaattgctggaaaatggcattccagccgaaattctttccgcttatctcagccagcatgacattgtgccggcgcgtaccaccgattttattgttctttgcctgttttctatcggcgtcaccaaaggtaaatggggaacattaatcaatgtattgttgaatttcaagaaacactatgacgctaatacttcacttaaacaatgtttgccaaaactcgcgaagcaataccctgaatattatgaaaacatggggctcaaagatatttcggataaaatatttgggtatataaaagaatatgaaatggatattgagcaaaagaaatcatttagccaattacctgagatagtgaaactcccccgacaagcacaccttgatcatatggcaggccgtactgaacatttaccacttaatgaactcgccgggcgcatatcggctgtaagtgtcattccttatccaccaggtataccaataatcctaccgggagaacgttttggtgatgaacatgccccccggttacaatatattcgccaactcggtgaatggaataacaagttccccggctttgaaaaaatcctggaaggcgcagagatgataaacggcgagtaccatatatgggtactaaaagagtga

SEQ ID NO: 817 - protein, 768 aa, Photorhabdus luminescens (subsp. laumondii); identical to SEQ ID NO: 399

SEQ ID NO: 818 - DNA, 1404 bp, Gloeobacter violaceus; identical to SEQ ID NO: 396
  CDS (1)..(1404)

SEQ ID NO: 819 - protein, 467 aa, Gloeobacter violaceus; identical to SEQ ID NO: 397

SEQ ID NO: 820 - DNA, 2259 bp, Chromobacterium violaceum; identical to SEQ ID NO: 394
  CDS (1)..(2259)

SEQ ID NO: 821 - protein, 752 aa, Chromobacterium violaceum; identical to SEQ ID NO: 395

SEQ ID NO: 822 - DNA, 1251 bp, Chromobacterium violaceum
  CDS (1)..(1251)
atgatcttccagaccctgctggcgccgggcgacaagctgctgctggatcgcaactgtcacaaatcggtccaccacggcgtgatcctgtccggcgcgcggccggtatacctggactcgtcggtcaaccgccagtacgggattttcgggccggtgcccaagaccacgatttaccaggcgatagacgacaatccggacgcgcgagtgctgatcctcacctcctgcacctacgacggcctgcgctacgacctgaagcccatcatcgaggccgcgcacgagaagggcatcaaggtgatcgtcgacgaggcctggtacggcttcgcccgcttccaccccgcgttccggccgacggcgctggagtccggcgcggactacgtgacgcagagcacgcacaaggtgctgtcggcgttctcgcaggccagcatgatccacgtcaacgacccgcgcttcgacgagcatttgttccgagagaacttcaacatgcacgcgtccaccagccctcagtacagcctgatcgccagcctggacgtggcgcgcaagcaggcggtgatggagggctaccgcttgttggaccgcacgctgaagctggcgcaggagctgcgcgagaagatcaattccaccggcgccttccgcgtgctggagctggacgatctgctgccggaagaggtgagggaggacggcatcctgctggatccgaccaagctgaccgtggacttcagccgctccggcttcaccgccgacgaactgcagcaggcgctgttcgagcgttacaacattcaggtggagaagtcgacgttcagcaccatcacgctgctgctgaccatcggcaccacccgcagcaagctgtcccgactttacgacgcgatgctgaggctggccaaggagggccgtgcgccgcggccgctggggcgcatgccggagattccgcacttctcccggctggcctgcctgccgcgcgacgccttctacgaggccggcgagcgcctgccgctgctggacgacgacggccggccgaatccggcattgagcgggcgggtgtgctgcgaccagatcgtgccgtatccgcccggcatcccggtgctggtgccggggcaggtggtggacgacaccatcctggcctacctggcgcggctgcagaaaacgcagaagagcatcgagatgcacggcttggcggaggatggcggcgagttttacctgcgggtgctgaagccgcaggagctggcggaattgcccggccgcagtttgttcaattga

SEQ ID NO: 823 - protein, 416 aa, Chromobacterium violaceum; identical to SEQ ID NO: 393

SEQ ID NO: 824 - DNA, 2136 bp, Shigella flexneri
  CDS (1)..(2136)
atgaaatcaatgaatattgccgccagtagtgaactggtatcccgactttcttctcatcgccgcgtggtggcgttgggagatactgattttacggacgtcgcggcagtcgtcattaccgctgcggatagtcgcagtggcattcttgcgttgcttaagcgcaccggttttcatctaccggtgtttttgtattccgaacatgctgttgaattacctgcgggcgttacggcggtaatcaacggcaacgagcagcagtggctggagctggaatccgcagcctgtcagtatgaagagaatttgctgccaccgttttatgacacgctgacgcagtacgttgagatgggcaacagcacctttgcttgccctggacatcaacatggtgcgttctttaaaaagcatcctgccggacgccatttttacgatttctttggtgagaacgtctttcgcgccgatatgtgtaacgctgacgtaaaattgggcgatctgcttattcatgaaggatcggcgaaagatgcgcagaaattcgcagccaaagtctttcatgccgataaaacctattttgtgctgaacggcacatcggcagcgaataaagtggtgacgaatgcgctgttaacgcgtggcgatctggtgctcttcgaccgtaacaaccataagtcgaatcatcacggcgcgctgattcaggcggggacgacgccggtctatctggaagcttcacgtaacccgtttggtttcattggcggtattgatgcgcactgttttaatgaagagtatctgcgccagcaaattcgcgacgttgcgccagaaaaagccgacctgccgcgcccgtttcgcctgacgattattcagctgggaacctatgacggcactgtctataacgcccgtcaggtgatcgataccattgggcatctgtgtgattacattctgtttgattccgcgtgggtcggttacgaacagtttatctcgatgatggcggatagctcgccgctgctgttagaacttaacgaaaacgatccggggatttttgtgacccagttggtgcacaaacagcaggctggattctcacagacgtcgcagatccataaaaaagataaccatatccgcggacaggcgcgtttttgcccgcataagcggttgaataacgcctttatgctccatgcttctaccagccctttctatccgctgtttgctgcactggatgttaacgccaaaattcatgaaggggagagtgggcgtcggctgtgggctgagtgcgttgagttgggtattgagtcgcgcaaggctattcttgcgcgctgtaagctgttccgcccgtttatcccgcccgttgttgatggcaaattgtggcaggattatccgacatcagtgttagccagcgaccgccgttttttcagttttgagccgggggcgaagtggcacggctttgaaggatatgccgcggatcagtattttgttgatccgtgcaagctgttactcactacaccaggtatcaatgccgaaaccggcgaatatagcgactttggcgttccggcgacgattctggcgcactatctgcgtgagaacggcattgtgccggagaagtgcgatctcaactccattctgttcttattaactccggcggaaagccacgagaagctggcacaactggtggcgatgctggcgcaatttgaacagcatattgaggatgactcgtcgctggctgaggtgttgccgagcgtttataacaaatatccggtgcgctatcgcgactacaccctgcgccagttgtgtcaggagatgcacgatctgtatgtcagtttcgacgtcaaagacctacaaaaagcgatgttccgccagcagagtttcccgtcagtggtgatgaacccccaggatgcgcatagcgcttatattcgcggtgaagtggagttggtgcggattcgtgatgccgaagggcgaattgcggcagaaggggcgttgccttatccacctggcgtgctttgcgtggtacccggggaagtctggggtggggcggttcaacgttatttccttgcgctggaagaaggcgtgaatttgttgccgggattttcgccggagttgcaaggtgtctatagcgaaaccgatgcggatggcatgaaacgattgtacggttatgtgttgaagtaa

SEQ ID NO: 825 - protein, 711 aa, Shigella flexneri
MKSMNIAASSELVSRLSSHRRVVALGDTDFTDVAAVVITAADSRSGILALLKRTGFHLPVFLYSEHAVELPAGVTAVINGNEQQWLELESAACQYEENLLPPFYDTLTQYVEMGNSTFACPGHQHGAFFKKHPAGRHFYDFFGENVFRADMCNADVKLGDLLIHEGSAKDAQKFAAKVFHADKTYFVLNGTSAANKVVTNALLTRGDLVLFDRNNHKSNHHGALIQAGTTPVYLEASRNPFGFIGGIDAHCFNEEYLRQQIRDVAPEKADLPRPFRLTIIQLGTYDGTVYNARQVIDTIGHLCDYILFDSAWVGYEQFISMMADSSPLLLELNENDPGIFVTQLVHKQQAGFSQTSQIHKKDNHIRGQARFCPHKRLNNAFMLHASTSPFYPLFAALDVNAKIHEGESGRRLWAECVELGIESRKAILARCKLFRPFIPPVVDGKLWQDYPTSVLASDRRFFSFEPGAKWHGFEGYAADQYFVDPCKLLLTTPGINAETGEYSDFGVPATILAHYLRENGIVPEKCDLNSILFLLTPAESHEKLAQLVAMLAQFEQHIEDDSSLAEVLPSVYNKYPVRYRDYTLRQLCQEMHDLYVSFDVKDLQKAMFRQQSFPSVVMNPQDAHSAYIRGEVELVRIRDAEGRIAAEGALPYPPGVLCVVPGEVWGGAVQRYFLALEEGVNLLPGFSPELQGVYSETDADGMKRLYGYVLK

SEQ ID NO: 826 - DNA, 1401 bp, Prochlorococcus marinus (strain MIT 9313); identical to SEQ ID NO: 388
  CDS (1)..(1401)

SEQ ID NO: 827 - protein, 466 aa, Prochlorococcus marinus (strain MIT 9313); identical to SEQ ID NO: 389

SEQ ID NO: 828 - DNA, 2271 bp, Bordetella parapertussis; identical to SEQ ID NO: 386
  CDS (1)..(2271)

SEQ ID NO: 829 - protein, 756 aa, Bordetella parapertussis; identical to SEQ ID NO: 387

SEQ ID NO: 830 - DNA, 1383 bp, Bacillus cereus; identical to SEQ ID NO: 382
  CDS (1)..(1383)

SEQ ID NO: 831 - protein, 460 aa, Bacillus cereus; identical to SEQ ID NO: 383

SEQ ID NO: 832 - DNA, 1422 bp, Bacillus cereus
  CDS (1)..(1422)
atgaatcaaaatcgtatgcctttatatgaggcgttaatagagtttaaagaaagagggccgttatcctttcatgttcctggtcataagaatggtttaaacttccctcaggaggcaataagagagtttaaaggtattctatctattgatgtaactgaattagcaggactagatgatttgcatagtccgtttgaatgtatagatgaggcacaacaattattggctgaagtttataatacaaagagaagttattttttaattaatggttcaacagtcgggaacttagcaatgattttgtcttgttgcggggaacatgatattgttcttgtacaaagaaattgtcataaatcaattattaatggtttaaaacttgcgggagcaaatcccatttttttagatccatggattgatgaagcttataacgtaccagtgggagttcgtaatgaaattattaagaacgcaattggaaagtatccaaatgcgaaagcacttattttaacgcatcctaattattatggtatggggatggatttagaggcaagcatcgcttttgcacatgcacataaaatccctgttttggtagatgaggcacatggggcacatctatgtttgggagaaccatttccgaagtcagcattaacatatggtgcagatattgtagttcattctgcacataaaacattacccgcaatgacaatgggttcctatttacatataaatagtcatttagtagacgaagataaggttactacttatttaagtatgctacaatctagtagtccatcgtatccaattatggcttccttggatatagcacgctttacaatggcgcgtataaaagaagaaggtcacagtgaaattgttgagtttttacgaagatttaaggaacaattacgttctattccccaaatcgccattttagaatatccgttgcaagatgagttaaaggtcaccgtacaaactcgttgtcagttatcagggtacgaattacagtctgtatttgaaaaggtcggtatatatacagagatggctgatccgtacaatgtcctatttattttacccttacaagtaaatgagggatatatgaaggttatagagatgatccgagtagcattgcaacattatgaggtgaaagacaagagggaatctattcgttatacttataatggtgaattctctcttttaccgtatacgtataaacaactagacggatatgaaacaaagatagtatctatagaagaggctgttggaatgatagcggcggaaatggtgattccgtatccacctggaattccattaattatgtatggagagagaattacttcagagcataaagagcaaattatgtatttagaaagagcaggagctcgttttcaaggtaatacgaaatatatgaaagtgtatgatatagaaagtaggttttag

SEQ ID NO: 833 - protein, 473 aa, Bacillus cereus; identical to SEQ ID NO: 381

SEQ ID NO: 834 - DNA, 1482 bp, Bacillus anthracis; identical to SEQ ID NO: 378
  CDS (1)..(1482)

SEQ ID NO: 835 - protein, 493 aa, Bacillus anthracis; identical to SEQ ID NO: 379

SEQ ID NO: 836 - DNA, 1422 bp, Bacillus anthracis
  CDS (1)..(1422)
atgaatcaaaatcgcatacctttatatgaagcattaatagagtttaaagaaagaagacggttatcctttcatgttccaggtcataaaaatggtttaaacttccctcaggaggtagtagaggagtttaaagatatactatctatcgatgtaactgagttgtcaggattagatgatttacatagtccgtttgaatgtatagatgaggcacaacaattattagctgatgtatatggagtgaacaaaagttattttttaattaatggttcaacagtcgggaatctagcaatgattttgtcttgttgtggggaacatgatattgttcttgtacaaagaaattgtcataaatcgattattaatggtttaaaattagcgggagcaaatcctatttttttagatccatggattgatgaagcttataacgtaccagtgggaattcatgatgagattattaaggaagcgattgaaaaatacccaaatgcgaaagcgctcattttaacgcatcctaattattatggtatggggatggatctagaggcaagcattgcttatgcacatacacataaaatccctgtgctagtagatgaagcacatggggctcatttttgtttaggcggggcatttccacagtcagcgttagcatatggtgcagatatggtagttcattctgcgcataaaacattacccgcgatgacgatgggatcctatttacatataaatagtcgtttagtgaaagaagaaaaagtttctacttatttaagtatgctacaatctagtagtccatcgtatccaattatggcttctcttgatattgcacgctttacaatagcacgtataaaagaaaagggacatgatgaaattgtcgagtttttacaggaatttaaagaagaattgagtactattccacaaatagctattttacaatatccattacaagacgggctaaagattaccgtacagacgcgttgtcggttatcaggatacgaattacagtctgtatttgaaaaggtcggtatatatacagaaatggcagatccatataatgtcttatttattttgcctttgcaagtaaataagaaatatatgaaggctatagagatgatccgagtagcattgcaatactatgaggtgaaagacaagacggaatctattcgttatacttataaaggagaaatttctcccctgccgtatacatataaacaactggaagaatacgaaacaaaagtagtacctatagaagaagcagttgggatggtagcagcggaaatggtaattccgtatccacctggtattccattgattatgtatggagaaagaattacttcaggacataaagaacaaattatgtatttagaaaaagcaggtgctcgttttcaaggtagcaggaaatatatgaaagtgtatgatatagaaagtaggttttag

SEQ ID NO: 837 - protein, 473 aa, Bacillus anthracis; identical to SEQ ID NO: 377

SEQ ID NO: 838 - DNA, 2142 bp, Shigella flexneri; identical to SEQ ID NO: 384
  CDS (1)..(2142)

SEQ ID NO: 839 - protein, 713 aa, Shigella flexneri; identical to SEQ ID NO: 385

SEQ ID NO: 840 - DNA, 2127 bp, Escherichia coli; identical to SEQ ID NO: 334
  CDS (1)..(2127)

SEQ ID NO: 841 - protein, 708 aa, Escherichia coli; identical to SEQ ID NO: 335

SEQ ID NO: 842 - DNA, 1563 bp, Oryza sativa
  CDS (1)..(1563)
atgcggcatgttgtagtacaatgtgccacttcatgggacactccaagaacgtctactactaatggttcacatgctgaaccttcagcagttgtcaaagctggtactgcccctctgattcaggcactgaaatcaactgcaaatcaagatgtttcttgctttcactttcctggacataatagagggaaagcttctcctccttcattgtcagaacttattggctcaaggacatttttgcatgacttacctgagctacctgagcttgatgatctcttctcccctaaaggtgtgattttagatgctcagaagcgagcagctgaactatttggatcatttaaaacatggttcctggtcaatggaagtacatgtggaatccaggcctcagtgatggctacctgttcccctggtgactacctcatcatacctcgaaattgtcatatttcagtgatctctgcactggttttgtctggtgctgtgcccaaatatatagtacctgagtacaattccgggtgggacattgctgggggtattaccccatcgcaggtggataaagtggttaaggaactggaggaggacagaaagaaggtaggtgctgttcttgttacatcaccaacctatcatggcatatgcagcaatatacaaggaattgtcaatgtttgccacctgcaaggcattcctgttatagttgacgaggcgcatggtgcccatttcaggtttcacagaaattttccaagcagcgcaactgagcaaggtgccgacttggttgtgcaatccacacacaaggttctgtgctcgcttacacagtcctcaatgcttcacatggctggagatcttgtggatgcagataaagtaagccaatgcctccaattgctccagagctcaagcccaagttaccttctactctcttctttggatgccgcaagggctcagctgagtgagaatgcagaatcttttgatgaaccagtatctatggctttagaaacaaaacatcagctgaggattatcccaggaatatctgttttggacttatcaagctttctttctgattttcctgctattgatcccttgcgtatcacattaagtgcttcagatctgcaattatctggatatgaagcagatgattttttagctgaggagcatcaaattgtatctgagctggtcggtacacaggccgtgacatttgcagtcaacttagggaccagaaggcatgatgttcagaggcttgtacattctgtaaagcatctgtcagaaaaatacttctctgaaaatgggtccagttccagaaaagagaatcctgctagtagcccactggacaagttctccatcaagttgacaccaagggaggccttctttttaaagaagaggagagtgtccatcgaggatagccttggtgagatttgtggtgagcttatctgcccttatccaccaggtatcccggtgctgatcccaggtgagatagtaacgcaggattcactgtcatacttgatggatgtcagggacaacggcatagcaatcagtggagcagctgatggtgagctcaagtccattatggtatgcaacgtgtga

SEQ ID NO: 843 - protein, 520 aa, Oryza sativa; identical to SEQ ID NO: 327

SEQ ID NO: 844 - DNA, 1641 bp, Oryza sativa
  CDS (1)..(1641)
atgcggcatgttgtagtacaatgtgccacttcatgggacactccaagaacgtctactactaatggttcacatgctgaaccttcagcagttgtcaaagctggtactgcccctctgattcaggcactgaaatcaactgcaaatcaagatgtttcttgctttcactttcctggacataatagagggaaagcttctcctccttcattgtcagaacttattggctcaaggacatttttgcatgacttacctgagctacctgagcttgatgatctcttctcccctaaaggtgtgattttagatgctcagaagcgagcagctgaactatttggatcatttaaaacatggttcctggtcaatggaagtacatgtggaatccaggcctcagtgatggctacctgttcccctggtgactacctcatcatacctcgaaattgtcatatttcagtgatctctgcactggttttgtctggtgctgtgcccaaatatatagtacctgagtacaattccgggtgggacattgctgggggtattaccccatcgcaggtggataaagtggttaaggaactggaggaggacagaaagaaggtaggtgctgttcttgttacatcaccaacctatcatggcatatgcagcaatatacaaggaattgtcaatgtttgccacctgcaaggcattcctgttatagttgacgaggcgcatggtgcccatttcaggtttcacagaaattttccaagcagcgcaactgagcaaggtgccgacttggttgtgcaatccacacacaaggttctgtgctcgcttacacagtcctcaatgcttcacatggctggagatcttgtggatgcagataaagtaagccaatgcctccaattgctccagagctcaagcccaagttaccttctactctcttctttggatgccgcaagggctcagctgagtgagaatgcagaatcttttgatgaaccagtatctatggctttagaaacaaaacatcagctgaggattatcccaggaatatctgttttggacttatcaagctttctttctgattttcctgctattgatcccttgcgtatcacattaagtgcttcagatctgcaattatctggatatgaagcagatgattttttagctgaggagcatcaaattgtatctgagctggtcggtacacaggccgtgacatttgcagtcaacttagggaccagaaggcatgatgttcagaggcttgtacattctgtaaagcatctgtcagaaaaatacttctctgaaaatgggtccagttccagaaaagagaatcctgctagtagcccactggacaagttctccatcaagttgacaccaagggaggccttctttttaaagaagaggagagtgtccatcgaggatagccttggtgagatttgtggtgagcttatctgcccttatccaccaggtatcccggtgctgatcccaggtgagatagtaacgcaggattcactgtcatacttgatggatgtcagggacaacggcatagcaatcagtggagcagctgatggtgagctcaagtccattatgctttcctctccagaacggaagcggaagcctcaatctgaacatagcatcaggtacaagtttgcacacctgcatggttctccagaagcatgttga

SEQ ID NO: 845 - protein, 546 aa, Oryza sativa; identical to SEQ ID NO: 325

SEQ ID NO: 846 - DNA, 1461 bp, Clostridium tetani
  CDS (1)..(1461)
atgtacagattaaatcaatcagaaactccattatttgatgcgttaatggaatatgtgaatagacaaactataccttttcacgttcctggtcataaaaaaggagtaggaatagatgaggaatttaaaaattttataggtgagaatccttttaaaatcgatgttactgtttttaaactagtggatagcttacatcatcctacaggtcctataaaaaaagctcaagcattagcttctgatgcatatggctctgatgcttcatttttttgtattcatggtacctctggtgctatacaggcaatgataatgtctgtggtgaaatctggtgataaaataattatcccaagaaatgtccataaatcagtaacttctggcattatattaagtggggctacccccatttatatgcaaccagaattagataaaagagttggtatcgctcatggcgttactcctgaaactgtagaaaaaacattaaaagaaaatcctgacgctaaagcagttttaataattaatccaacttattatggcgttgctactgatattaagaaaatagcagatatagttcataattatgatattcctttaattgtagatgaagctcatggtcctcatttagcttttaacgatacacttccaatatcagctattgaagctggtgctgatatttgttgccaaagtacacataaaataataggtgctctaactcaatgttcattacttcacgttcgttctaaaagtatagatgtaaatagagttcagcaaatgttaagtttacttcaaactacatctccttcatatatattaatggcttcacttgactgtgctagaagacaaatagctttaaatggtaaggaattattagataaatccatagctttatctaactatgcccgtgaagaaataaataaaattcctggcttctattgtttcggtaaagaaattgttggaagacctggtgtttttgctatagatcctactaaaataactataacctgtagagatttaggtattactggttttgaattagatatgattttatctaaccaatatcacattcaactagaattatcagatttatataatggtcttgctgtaggctcctttggagatacaaaggaaaatatagatgcactaattaatgcactaaaagaaataagtaaagagtatgtaaataatgagaataaaaaatctgactttatagatataccagctataccaaagcaagttcaaattcctagagatgcttttaatagtgaaaaagtagttcttcctttaaaagatagtgaaggaagagttagtggggaatttttaatggcttatcctcctggaatacctgtactttgccctggggaaataattactcaagaaataattgattatatacaaaaattaaaagatactggtctttatgtacaaggtacagaagatttagaagtgaattttataaaagttgtaaaataa

SEQ ID NO: 847 - protein, 486 aa, Clostridium tetani
MYRLNQSETPLFDALMEYVNRQTIPFHVPGHKKGVGIDEEFKNFIGENPFKIDVTVFKLVDSLHHPTGPIKKAQALASDAYGSDASFFCIHGTSGAIQAMIMSVVKSGDKIIIPRNVHKSVTSGIILSGATPIYMQPELDKRVGIAHGVTPETVEKTLKENPDAKAVLIINPTYYGVATDIKKIADIVHNYDIPLIVDEAHGPHLAFNDTLPISAIEAGADICCQSTHKIIGALTQCSLLHVRSKSIDVNRVQQMLSLLQTTSPSYILMASLDCARRQIALNGKELLDKSIALSNYAREEINKIPGFYCFGKEIVGRPGVFAIDPTKITITCRDLGITGFELDMILSNQYHIQLELSDLYNGLAVGSFGDTKENIDALINALKEISKEYVNNENKKSDFIDIPAIPKQVQIPRDAFNSEKVVLPLKDSEGRVSGEFLMAYPPGIPVLCPGEIITQEIIDYIQKLKDTGLYVQGTEDLEVNFIKVVK

SEQ ID NO: 848 - DNA, 1416 bp, Clostridium tetani; identical to SEQ ID NO: 372
  CDS (1)..(1416)

SEQ ID NO: 849 - protein, 471 aa, Clostridium tetani; identical to SEQ ID NO: 373

SEQ ID NO: 850 - DNA, 2766 bp, Bradyrhizobium japonicum; identical to SEQ ID NO: 370
  CDS (1)..(2766)

SEQ ID NO: 851 - protein, 921 aa, Bradyrhizobium japonicum; identical to SEQ ID NO: 371

SEQ ID NO: 852 - DNA, 2517 bp, Bradyrhizobium japonicum
  CDS (1)..(2517)
atgatagtcggactcgcggaagctcctcctcacccgaattgctgcgcaatccgcctctccccgcaagcggggagaggcgaaacgccagccgcagctcctgtcatccaactgtcatcgaatgtgccgagagctgtgtctccagtacattcgggacagacaatggactatttcaagcgcttcaacttcctgttcgccgcacccgtgttcgacgccgacgacctcgaaggcgtccgcttcaaccagatcatcgaggaaatccagcgctccggcttcgaggtcgtccgggcccgcaagctggaggacgcggagatcgcggtgcagaccgacgccgcgatcggctgcatggtggtggactggggcaagaagggcctggagggcaagacctcggcgctgatcaatttgatgcggcgccgcggcctcgacttcccgatcatcctgctgatccggcgcaagcggttcgaggatctgccggtcgaggtgctcgacttcatcgacggctatgtcttcctctccgaggagacgccgaccttcatcgccaagaacctgatcagccggctcaagcaatatgccgagacgctgaagacgccgttcttcggcgcgctggtcgactatgccgaggaaggcaaccagctctggacctgtccgggccacaatggcggcgtgttctacaatcgcagcccgatcggccgggtgttcgtcgagcatctcggcgaatccgtgttccgcgacgacctcgacaattccgtgctcgacctcggcgacctccttacccatgagggcccggcgctgaaggcgcagaaggaggcagcggcgatcttcggcgcggagaagacctatttcgtgctcaacggcacctcgacctcgaacaaggtcgcgctcggcgcgctcgtcaccgacggcgatctcgtgctgttcgaccgcaacaaccacaaggccgctcatcacggcgcgctgatgatcaatggcggcatcccggtctacgtcccgaccattcgcaacgcctggggcctgatcggcccgatgcgctgggacgtgctcgacgagaaggcgctgcgcgaggcgatccgcaaccatccgctggttagggatcgcgacgcctggcgcaaggaacggccgttccgcgtcgccgtggtcgaacagtgcacctatgacggctcgatccacagcgccgagatgatcctgaagcgcatcggccatctctgcgaatacatcctgttcgacgaggcctgggccggcttcatgaaattccacccgctctatgccggccgcttcgccatgggcctcgcgaaccttcccccggaagcgcccggcatcatcgcgacgcagtcgacccacaagcaactcgcgagcttctcgcaggcctcgcaaatccacatcaaggaccgtcacatccgcggccagaagcggcgcgtcgagcatcgccgcttcaacgaaagcttcatgcagcacgcttccacgtcaccgttctatccgctgttcgcatccctcgacgtcggcgcgcagatgatgaaggggcgctccggcgaagtgctgtgggacgacacgatccggctcggcatcgagctgcgcaagaagatccgcgcaatgcggcgtgagttcgaggagaaggagcagaaccccgatcggcgctggttcttcgagcccttcgtcccggatcgcgtcgccatccccgacgtcagtcgccccggcgccgcccacaatgtcgcctgggagacgctgtccaccgacgagctcgccaccaatcccgccttgtggcaactctctccggataccaactggcacggctttcccgatctcgcggaaggctttgccatgaccgatccgaacaagctgacgctgctcacgcctggcttcgatcgcaccaccggcgcctatgccgagcacggcatccccgcccccgtcgtcgcgcaatatctgcgcgagaaccgcatcgtgcccgagaagaacgacctcaactccctgctcttcctgctcactcccggcgtcgaggcgagcaaggccggcacgctgatctccggcctcgtcgccttcaagaggctgcacgacgacaatgcgttgctggcggacgcaatcccggaattctaccagcggcggcaggcgcgctatgccggcgtgcggctgcgcgatctctgcggcgacatgcaccgtttcttccgcgccgccgatgtcagcgcgctccaggcgcggcagttcatgcccgagcacatgcctgagatcgcgatgtcgccccgcgatgccgcccgctatttgttccgcaacgacgtcgactatctgccgatcgaggcgatcgcgggccgcatcgccaccacgcccttcgtagtctatccgcccggcatcgccaccatcgtgcccggcgagcggctgacggaacgcgccaagcccatggtcgattatctcaagatgttcgagacctgcttcaacacgttcccgggcttcgacgtcgaaatccagggcgtctacaaggagatcgatgcccagggccgtatcgggctctatacttacgtcgttgccgagtag

SEQ ID NO: 853 - protein, 838 aa, Bradyrhizobium japonicum; identical to SEQ ID NO: 369

SEQ ID NO: 854 - DNA, 2181 bp, Vibrio vulnificus; identical to SEQ ID NO: 366
  CDS (1)..(2181)

SEQ ID NO: 855 - protein, 726 aa, Vibrio vulnificus; identical to SEQ ID NO: 367

SEQ ID NO: 856 - DNA, 1314 bp, Synechococcus elongatus
  CDS (1)..(1314)
atggagcccctgttgcgtgccctttggggaaccgccttagaacaagacctgagtgagttgcccggccttgataatttggctcaacccacaggggtgctggcagaggcacaggcggtagtggcagcgacagtggggagcgatcgcgcctggtttctcgtcaatggtgccactggtggccttttggccgcccttttggcaaccgttggtcctggcgatcgcgttctcgtcggtcgcaatgtccaccgctcagtgattgcggggctggtgttagcgggggcaaagcctgtttatttgggagttggggtggatccgcagtgggggctgccatggccagtcactcgtgatgtggttgccgctggcttggccgcctatcccgatactaaggcagtggtgcttgtcagtcccacctatgaaggcctctgctcccccttgctagagattgcccagtgtgtccataaccacggtgtgccgctcattgttgatgaagcccacggcagccattttgcctatcatcccgcctttcctgttaccgctttggccgcaggcgcggatgtggtggtgcagtcgtggcacaaaaccctcggaacgttaacccaaacggcagtgctgcatctcaagggggagcgggtgtctgctgaacgcttgagtcaggccctaaaccttgtgcaaaccagcagtcctaactactggttgctggcagcccttgagggagcaggcgttcagatggcgcagcagggagagcaaatctacgggcgacttctccagtgggtcaagacctttgaatggcctctgccgcgatggcagcccccgggcatccctcaggatccgttgcgattgaccctagggacttggccgataggtctgacggggtttgccctcgatgagcttctgcaaccgcagatcattgctgagtttcccagtgggcgatcgctaaccttttgccttggcctcggtaccacacaaacaatgctagaaaccttggccgatcgcctgaaaagtgtttacactgaatactgccacaatgccccgctgccgcccctggccatcccatcaatccccagttgccaagaaccggcactctcaccacgggaggcctacttttgcccacagcgatcaattcccctgagggcggccctcaatgagattagtgccgaaacgatcgccccctacccgcccgggattcccactgtcattgctggcgaacgattcactgaatcagtgattgcaacgttgcaaaccctccaagaactaggggcagagatggtgggggccagcgatccaacgctgcaaaccctaagaatttgcaaagtctag

SEQ ID NO: 857 - protein, 437 aa, Synechococcus elongatus; identical to SEQ ID NO: 365

SEQ ID NO: 858 - DNA, 2163 bp, Shewanella oneidensis; identical to SEQ ID NO: 362
  CDS (1)..(2163)

SEQ ID NO: 859 - protein, 720 aa, Shewanella oneidensis; identical to SEQ ID NO: 363

SEQ ID NO: 860 - DNA, 1419 bp, Oceanobacillus iheyensis
  CDS (1)..(1419)
atgaagttggatcaatcttatatgccattcgtagatcatttaagaaatttcagttcaaagagaccggtatcattccatgttccagggcataagcatggggcggtttttcctgaagcagctagagaattatttggctctattttatctgtagatgtaactgaaatagcaggaatggatgacttgcatgcaccaagtgagatcatcgcagaagcagaaaaactagcaacagattatttcaattctgaccatacattttttttagttggaggatctacatcaggtaatctagcaatgattatggcagcatgtaatccgggagatgaggtaatcgtccaacggaattgtcataaatcaattatgaatggcttagaacttgcaggtgcaaagccaatatttatagctccagagtggagagatgatttacaacgatataccgcaccaacatatgatagcataaaacaagcaatgttgaggtttccgaatgcaaaggctcttattctcacctatccagattactttggggcggtttttgatattcagtccatgattgaattagcacacacctatcatattccagtatttgttgatgaagcacatggcgtccatttttcatcatctgaaatgtttccacaatcggctttacagttaggagcagatgttgtagtacaatccgcacataaaatggctccagctatgacaatggctgcatatttacatattggcacttcacgtgtagaaaaacatcgacttgcttattatttgcaaatgttacagtcgagtagtccatcttatccgataatggcttctttggatgtagcaagattttatttagcgcaattatcaaaagaaaaaatccgaggtatcttaaatagtgtagaaaacgtaagaaacatattctccggggcatcattttgggaattggtacctcatgatgatccgttaaaattaacgttccacgtgaaacatggctataaaataagtgagatagaatcgatgctcgaatatcatggaatttatccagagttaacgacagaaaatcaattcttattcatacatggtttagcgccttttgtagaacaagattatttgaaaaaaacaatacaattgatagaggaagaattaaaaaaatcagtgaaacatgctacaatagaaggggcaaagctttttaccaatcctatagaggaactagcattgtcataccaagaaatgaaacacattacatcacttcttgtcccatttgctcaaagtgaaggtgaaattgcagcagaggcagtgatcccatatccccctggtattccagtcatactcaaaggcgagagaattacgaaggcgcatattacaaagattcagcttttgattcaacaaggagtaaccattcagcaacgggaagaaggaatacgtatatataggaaggcatga

SEQ ID NO: 861 - protein, 472 aa, Oceanobacillus iheyensis; identical to SEQ ID NO: 361

SEQ ID NO: 862 - DNA, 2370 bp, Escherichia coli
  CDS (1)..(2370)
atgaaatttaaccacaatcttttatttatttcctcacaatatcttgatggcgacaacccttcgcagcaggtactggaagagcttcaaaccgaactcgcggaacgcggttttaaaattcatatcacgcaccagatctctgatggattaaaaatcatcgaaaaaagcccccaatacagcgggattggtttttactgggagccagacaatccgacctttgcagaagagctacagcactttatcagcatattccgcaaaagaaatgccacgacgccgctgataattttctcagaacagaatattaccgatcgtatcccactcgacgtcttaaaagaggtcagcgaatatgtttatctgttctctgaatccgcagccttcactgccaatcgactgtactccttagtccaccgctatgcggataagcttcttcctccctactttaaaacccttaaggactttaccgaggacggtgactattactgggactgcccggggcatatggggggaatggcctatctgaaacatcctgttggcattgagttcattaacttctttggcgaaaacatgatgcgcgctgatattggcgtggctaccgcggagatgggggattatctgatccacgccggaccgcctaaaaaatcggaagaaattgcggcccgactgtttggctctgattggaccttctacggtgtttccggctcatcggggtcgaaccgtattgtggcccaggctgcggttggcgcagatgaaattgccattattgaccgaaattgccacaagtcacttaatcatggcctgaccttgtctcaggcaaggccggtttacctgaaacctacccgcaacgcgtgggggctgattgggcctatcccgaccggacgcctgaagaaggccagtattgatgcgctggtggcaaacagccgactggcatctggtgcggtcagccagtccccgtcctacgccgtggtaaccaactgcacctatgatggcttctgttataacgtgaacgatgtagtcagacacctgggtgaaagcgcaccgcgcatccattttgatgaagcatggtatgcctatgcgcgtttccatccgctataccagagtcgctatgcaatggacgcggaggaaacgccaaatcgtccaaccctattcgccgtacagtccacccataaaatgctgccctcactctccatggcctcaatgattcatgtgaagaaaagcgatcgcgcgccgcttaatttcgatgactttaacgatgcctttatgatgcacggcacgacctcaccctactacccgatcattgcatcaattgatgtggcagtaagcatgatggagggtgaatccggttattcgcttgtgcaggagtcaattgaagaagcgattgccttccgtaaagccgtggtcagcgtcaagcgccagctccaggagcaggaaggtggtgacgcctggttcttcgatgtgcttcagccaaccgaagtgcaggacagcgattctgggcagcgatacagttttgaagaggcacccgtatcgctgctgagccacagcgccgactgctggtcgctgcgctccggtgagcgctggcacggttttgccgatgatgatctggtcgaaaccaacagtatgctcgatccagtaaaagtgaccctgacttgtccagggatcggcccgaagggagaataccagaaaaacggtattccgggatatttgctgacccgttttctcgatgaccgtcgcattgaaattgcccgtactggtgactacaccgtgctgatcctgttctccgtcggcatcaccaaaggcaaatggggaactctgattgaaagcctgctggcctttaaaaagcattacgacaatgacgatctggccacagatgctatcccgtcgctgaaagcgcattctccacactacgacacgctaaccctcaaggagctatgtcagataatgcatgaaaaaatggatgagctggagctgatgtcgcatatcaacgacgcggtaaacaccgatccggaaccagttatgaccccggcagaagcctatcagaaagtcgtacgctacaaaaccgagcatatccggctggatgattttagcggcagaattgccgccagcatgctcgtcccatatcccccaggcattcctgtactgatgccgggcgaacggatgccgcaaggtaacaagggcattattggctatctgcgcgccctgcaggaattcgataagcaattcccaggttttgaacatgagatccagggcgttaacgtcgatgaaaacggggacttctgggtcagagcgattgtggaagaagaacgcgatgggcagtcgctacccggccacataacctttaaacgccaggtctctggtattaaaaagggccgccagtag

SEQ ID NO: 863 - protein, 789 aa, Escherichia coli; identical to SEQ ID NO: 359

SEQ ID NO: 864 - DNA, 1488 bp, Thermoanaerobacter tengcongensis; identical to SEQ ID NO: 354
  CDS (1)..(1488)

SEQ ID NO: 865 - protein, 495 aa, Thermoanaerobacter tengcongensis; identical to SEQ ID NO: 355

SEQ ID NO: 866 - DNA, 1419 bp, Thermoanaerobacter tengcongensis
  CDS (1)..(1419)
atgtcaactcctttgtacgatgctctcatggaatacgtgaaaaaggaaactgtaccttttcacatgcccggccataaacaaggaagagtattgccaaaagagtacattgaaaatttagcaaaaattgatttgacagaggtgccaggacttgacaaccttcacaatcccgatggtccaatccttgaagctgagaagcttgcagcaaagacctttgggtcaaaacaagctttctttttggtaaatggcagtactgctggaatatatgcggccatgtatgcagtgctaaaccctacggataaagtgcttgtgatgaggaattctcataaatctgtttacaacggagttgtgcttactcaatcgattcccgtgtatttgctgcccgagatagactatgaaaatggaattgcgatgggaattgatgtagaaaggctagaggaggttttgcaaaaagaaagagatgtaaaagctgtagtagtgacataccctaattattacggtttttgcagtgatattgaaaaaattgtggatattgtgcataagtacggtaaaattttgattgtagatgaagctcatggggctcactttcctttttcaaacaatttgcctaagtcctccataaaagcaggagcggatattgtagtacagagcctgcacaagactcttacttcttttactcaaacttctatactccatttaaattctgatagggtagatgtggatcggttaaaatattctttaagcctttttcaatctacatctccttcttatattctcatgtcttcaattgacatggcaagagaatacatggagaaagaaggcaaaaaaagactagaagaagttattcaattagccctatatgtaagaagagagattgataaaatggaaggtattagatgtttaggagaagatatagttggacggtacggcattgtggattttgatgttacaaagctcactataagtgtaaagaatttgggaattgaagggcctgaagcagaggattttttgaggagagaatgcaatatacaagttgaaatgtcggatgtttacaatatattagcgatggttactgtaggggatgatgaaaaaagggtaaaaatgcttttagaaggtttaaaaaagctttcaaaaaacaggaagagggttaaatttggggatagaattctttttccttctttgcctgaaatggagttgactccttcggaagctgtgaggaaaaagaaggtgagggtaccctttgaaaaggcggaaggggcgatttctgcagattttgtgacaccttatccgccaggagttcctctcatatgtccaggagagaggattgaaaaagatatggtaaaatatatagaagtattgtataataaaggtattaaggttttgggtatacaggataatttactgtcggtgtgtgagatatga

SEQ ID NO: 867 - protein, 472 aa, Thermoanaerobacter tengcongensis; identical to SEQ ID NO: 353

SEQ ID NO: 868 - DNA, 2352 bp, Fusobacterium nucleatum; identical to SEQ ID NO: 350
  CDS (1)..(2352)

SEQ ID NO: 869 - protein, 783 aa, Fusobacterium nucleatum; identical to SEQ ID NO: 351

SEQ ID NO: 870 - DNA, 1431 bp, Clostridium perfringens; identical to SEQ ID NO: 346
  CDS (1)..(1431)

SEQ ID NO: 871 - protein, 476 aa, Clostridium perfringens; identical to SEQ ID NO: 347

SEQ ID NO: 872 - DNA, 1455 bp, Clostridium perfringens
  CDS (1)..(1455)
atgaaaagactttctcaagaaaatgctcctatttatgaagcattaaaatggtacaagaatcaaagaattgttccttttgatgtaccaggtcataaacaaggaagaggaaatacagaattaagagaatttttaggtgaagattgtgtttcagtagatgtaaattcaatgaaacccttagataatctttgtcatccaacttctgtaataaaggatgcagaagaattagcagctgaggcctttggtgctgataaggcatttttcatggttaatggaaccacatcagctgtacaagccatgataatgagtgtttgcaaagatggagataagattataatgcctaggaatgtgcatagatctgcaataaattctttaataataacaggggtaactcctgtgtatataaatccaggaattcatggtagacttggaatttctctaggaatggcaatggaagatataaaaaaggccattaaggaaaatccagatgctaaggctatttttgttaataacccaacatactatgggatttgctctaatttaagagaaatagttaagttagctcatgaaaataatatgtatgtcttagttgatgaagctcatggaactcatttttattttgataaaagacttccagtatcagctatggaggcaggggcagatatggcagctgttagcatacataaaacaggaggctcattaactcagagttctatgttgcttatgaagtgtaatagaattaagccagattatgtgagaacaataataaacttaacacaaacaactagtggttcttatttacttttatcttctttagatattgctagaagaaatttagccttaaatggagaaaaaatatttgaagaggttgttggaatagctgaatatgcaagagaagaaataaataagataggtggttattacgctttctcaaaagaaataaataatggtgatgatatttatgattttgatgtaactaagcttactataaacactttagaaactggacttgctggaatagaagtttatgacatattaagagatgattatggaattcaaatagagcttggagatgtggctaatattcttgccataatatcagttggagatactagatataacattgagagattagtttcagctttaagtgagattaagagaattcatgaaaaagataaaaaagatatttttgaccacgaatatatagatcctatagttaaggttaagccaaaagaggctttttatgctgataagaagaaggttcttttaagagaaagtgaaggattaatttctggagaatttgtaatgtgttatccaccaggaattccaatacttgccccaggagagcttataactaaggagactatagactatattgagtattctaagaaaaagggaagtttagttacaggccctgaagatatggaaattgaatatataaatgttttagattgttag

SEQ ID NO: 873 - protein, 484 aa, Clostridium perfringens; identical to SEQ ID NO: 345

SEQ ID NO: 874 - DNA, 2280 bp, Ralstonia solanacearum (Pseudomonas solanacearum)
  CDS (1)..(2280)
atgaaattccgttttcccgtcatcatcatcgacgaggacttccgctccgagaacatctccgggtcgggcattcgcgcgctggcgcaggccatcgaagaagagggcatggaggtcacgggcctgaccagctatggcgacctgacctcgttcgcgcagcagtcgagccgggcgtccaccttcatcgtctcgatcgacgacgatgagttcatcaacccggacaacgacaagccggaaccggaagcggtggaaaacctgcgcagcttcgtggccgaagtgcgccgccgcaacgccaacatccccatcttcctgtacggcgagacgcgcacctcgcgccacctgcccaacgacatcctgcgcgagctgcacggcttcatccacatgttcgaggacacgccggagttcgtggcgcgccacatcatccgcgaagcccgcaactacctggattcgctgccgccgccgttcttcaaggcgctgatcgactacgcgcaggacagctcctactcgtggcactgcccggggcactcgggcggcgtggcgttcctcaagagcccggtgggccaggtgttccaccagttcttcggcgagaacatgctgcgcgccgacgtctgcaacgcggtggacgagctcggccagctgctcgaccacaccggcccggtggcggcctccgagcgcaatgccgcgcgcatcttcggctcggaccacatgttcttcgtcaccaacggcacgtccacctcgaacaagatggtgtggcacgccaacgtggcgcccggcgacatcgtggtggtggaccgcaactgccacaagtcgatcctgcacgcgatcatgatgacgggcgcgatccccgtgttcctgatgccgacgcgcaaccactacggcatcatcggcccgattccgcagagcgagttcgagcccgagaccatcgcccgcaagatcgccgagcatccgttcgccagccaggccgcgaacaagaagccgcgcatcctgaccctcacgcagggcacgtacgacggcgtgctgtacaacgccgagcgcatcaagcacatgctgtcgaccgagatcgacacgctgcacttcgacgaggcctggctgccgcacgcctcgttccacccgttctaccgcgacatgcacgccatcggccagggccgcgcgcgcagcaaggacgcgctggtgttcgccacgcagagcacgcacaagctgctggccggcctgtctcaggcttcgcagatcctcgtgcaggattccgagacgcgcaagctcgacacgtaccgcttcaacgaggcgtacctgatgcacacctcgaccagcccgcagtactcgatcatcgcctcgtgcgacgtggccgcggcgatgatggaagcgccgggcggcaccgcgctggtggaagagagcatcgccgaggccctggacttccgccgcgccatgcgcaaggtggagcaggagtacgtcggcacgaatggtggcaacggccgcggcgacgactggtggttcaaggtctggggcccgaacgacctgtccgatgaaggcatcgaggagcgcgaggcctggatgctcaaggccaacgagcgctggcacggcttcggcgacctggccgaggacttcaacctgctcgacccgatcaaggccaccatcatcaccccgggcctggacgtggacggcaagttcagcgagtcgggcatcccggcggccatcgtcacgaagtacctcgccgagcacggcatcatcgtcgagaagaccgggctgtactcgttcttcatcatgttcaccatcggcatcaccaagggccgctggaactcgatggtgaccgagctgcagcagttcaaggacgactacgacaacaaccagccgctgtggcgcgtgctgccggagttcgtgcggcagtatccgcaatacgagcgcatcggcctgcgcgagctgtgcgacgccatccacagcgtctacaaggccaacgacgtggcccgcgtgaccaccgagatgtacctctccaacatggagccggcgatgaagccgtcggacgcatgggccaagatggcgcaccgcgagaccgagcgcgtggccatcgacgacctggagggccgcatcaccgccatcctgctgacgccgtatccgccgggcattccgctgctgatcccgggcgagcgcttcaaccggaccatcgtgcagtacctgcagttcgcgcgcgagttcaacaagctgttcccgggcttcgagaccgatatccacgggctggtggaggaggagattgagggtcgggttgggtactttgtcgactgcgtgaggtga

SEQ ID NO: 875 - protein, 759 aa, Ralstonia solanacearum (Pseudomonas solanacearum); identical to SEQ ID NO: 349

SEQ ID NO: 876 - DNA, 2136 bp, Salmonella typhimurium; identical to SEQ ID NO: 342
  CDS (1)..(2136)

SEQ ID NO: 877 - protein, 711 aa, Salmonella typhimurium; identical to SEQ ID NO: 343

SEQ ID NO: 878 - DNA, 2199 bp, Salmonella typhimurium
  CDS (1)..(2199)
atgtcagaattaaaaattgccgttagccgtcattgcccggattgtttttctacacaccgtaatattgtaaatgttgatgagagtcgtttcatcgacgtggctgccatcgtgttatccattgacgacattgaacacggaaaactcgatgaaatcgacgcaacgggttacggtattcccgtgtttgtcgcgacacatgacgaagggcgcgtaccgcctgagtatttgccgcgtatctctggtgtattcgaatataatgaatcccgtactgccttctatggtcgccagttggaaaccgcagcaagccactacgaaacgcagttacgtccgccgtttttccgcgcgctggtggattatgtcaaccagggcaacagcgcatttgactgcccggggcatcagggcggcgaattcttccgccgtcatcctgccggtaatcagttcgtggaatactttggcgaaacgctcttccgctccgacctatgcaacgcggacgtggcgatgggcgatctgctgattcacgaaggcgcgccttgcattgcgcagcaacatgcggcgaaagtctttaacgccgataagacctactttgtgctgaacgggacctcctcctctaacaaagtcgtactcaacgcgctgttaacgccgggcgatctggtactgtttgaccgtaacaaccacaaatctaaccaccacggcgcattattgcaggcgggcgcaacgccagtttatctggaaaccgcgcgtaacccgtatggttttatcggcgggatcgacgctcactgcttcgaagaagattacctgcgcgagctgattagcgaagtcgcgccgcagcgtgcccgcgaagcacgtccattccgtctggccgtcatccagttaggcacctacgacggtaccatttataacgcccgtcaggtcgtcgataaaattggtcatctgtgcgactacatcctgtttgactccgcctgggtcggctatgaacaatttattccgatgatggccgattgttcgccgctgctgctggaactgaacgaaaacgatccgggtattctggtgacgcagtccgttcacaaacaacaagccggtttctcccagacctcgcagatccataaaaaagatagccatatcaaagggcaatcgcgctacgttccgcataagcgcatgaacaacgcctttatgatgcacgcctccaccagcccgttctatccgctgttcgccgcgctggacgttaacgccaaaatgcacgaaggcgtcagcggtcgcaatatgtggatggattgcgtggttaacggcatcgatgcccgtaaattgatcctcgaaaactgtcatcacatccgtccgttcgtaccggaactgattgatggtaagccgtggcagtcatacccgacgtcagagatcgccagcgatctgcgcttcttccacttcgttccgggagaacactggcatgcgtttgaaggctatgccgaacatcagtactttgtcgacccttgcaaactgctgctcaccacaccgggcattaatgcagcgagcggcgaatatgaagactttggcgttcctgccacgatcctcgccaacttcctgcgcgagaacggcgttgtgccggaaaaatgcgacctcaactccattctgttcctgctgacgccggcagaagacatggcgaagttacaacagcttgtcgccctgctggctcgtttcgaaaaactgctggaagctgatgcgccgttagcggaagtattaccgtccatctacaaacagcatgaagcgcgttatgccggctataccctgcgtcagctttgccaggagatgcacgatctctatgcgcggcacaacgtgaaacagctgcaaaaagagatgttccgtaaatcgcatttcccgaaagtcagtatgaatccgcaagaggccaactatgcctatctgcgcggcgaggtcgaactggttcgcctgccggaagcggaaggtcgtatcgcggctgaaggcgctctgccttacccgccgggagtgctgtgtgtagttccgggtgaaatctggggcggttctgtcctgcgttacttcagcgccctggaagaagggatcaacctgctgccgggctttgcgcctgaactgcagggcgtttatatcgaagaacacgacggccgtaagcaggtctggtgctacgtcattaaacctcgtgacgcacagcgctccctgctgaaggaggaaaaattatga

SEQ ID NO: 879 - protein, 732 aa, Salmonella typhimurium; identical to SEQ ID NO: 341

SEQ ID NO: 880 - DNA, 2142 bp, Salmonella typhimurium
  CDS (1)..(2142)
atgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctttttacctacgccaaagaaggaaaatataccttttgtacgccgggtcatatggcgggaacggcgtatcagaaaagcccgccaggctgcctgttttatgacttttttggcggcaataccttaaaagctgatgtgtcgatttcggtgactgaactgggatcgctgctggatcacaccgggccgcatctggaagcggaagagtatatcgcccgtacttttggcgccgagcagagctatatggtgacgaacggtacgtcgacctcgaataaaattgtcggtatgtatgccgcgcctgcgggaagtacgctacttattgatcgtaattgtcataaatcgctggcgcatttgctgatgatgagcgatgtggtgcctctctggttgaagccgacgcgcaatgcgctcggcattctcggcggtattccccgaagggaatttacccgtgcaagcatcgaaagcaagatagaggagacccctcaggcgcaatggccggtgcatgcggttatcaccaattcgacttacgatggtctgctgtataacactaactggatcaagcaaatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttccacatcgccgagctatcccattgtcgcctctatcgagaccgcagcggcgatgctgcgcggcaatccagggaaaagattgattaatcgttcggtggaacgggcgctccattttcgtaaagaggtacagcggctacgtgaagagtccgatagctggttctttgatatctggcagccggaagaggttgatgaggccgaatgctggccggtcacgccgggagaaacctggcatggcttcaccgatgccgatgacgatcatatgttcctcgatccggttaaggtgacaatcctgacgccggggatggatgaacagggcaacatgagcgaagaggggatacccgccgcgctggtggcgaagttccttgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggggctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgctcgattggccagcattatcccggttttgaaacggatattcacggcgcgaaacggaatgaagacggggtgtaccaggtacgagtcttaaaacacgcctgctag

SEQ ID NO: 881 - protein, 713 aa, Salmonella typhimurium; identical to SEQ ID NO: 339

SEQ ID NO: 882 - DNA, 2136 bp, Vibrio vulnificus
  CDS (1)..(2136)
atgaatattttcgctatcttgaaccacatgggtgtgttctttaaagaagagccagttcgccaattgcatgcagcacttgaaaaagccggttatgaagttgtttatccagtggatgacaaagatttgatcaagatgatcgaaatgaacccgcgcatttgtggtgtgctgtttgactgggataaatactcgcttgagctttgtgagcgtattagccaaatcaacgaaaaactgccagtacacgcgtttgctaacgagcaatcaacgctggatatttcgcttaccgatctacgcctaaacgtgcatttctttgaatacgcattgggcatggcggacgacatcgccatcaagatcaaccaagcgacacaagaatacaaagacgcgattacaccgccattcaccaaagcgctgtttaaatacgtggaagaaggcaaatacaccttctgtactccaggtcacatgggtggtacggcttttcaaaaaagtccagtcggcagcattttctacgatttctacggtccaaatactttcaaagcggacgtgtcgatttctatgccagagctaggctcactgcttgaccattcaggtccacacaaagaagcggaagagtacattgcgcgtacgttcaacgctgacgcatcgtacatcgtgacgaacggtacttcgacgtcaaacaaaattgtcggcatgttctctgcgccagcgggcagcacggtattggttgaccgtaactgtcataaatcattgactcacctaatgatgatgacggacgtaacacctatttacttccgcccaacccgtaacgcttacggcattcttggtggtattccacaaagtgaattcagccgtgaagtgatcgcagaaaaagtggctaaaacaccaggtgcgagcgcgccaagctacgcggtgattaccaactcaacttacgatggtttgttgtacaacacacaattcatcaaagagtctctcgactgtaaacacatccactttgatagtgcgtgggtgccttacactaacttcaaccgtatttacgaaggcaaatgcggcatgagtggcgaagcgatgccaggcaaagtgttctacgaaacacaatccactcacaaactgttggcggcgttctcgcaagcgtcaatgattcacgtaaaaggtgaatttgaccgtgagtcgttcaacgaagcctttatgatgcacacttccacctcgcctcaatacggcattgtggcatcaacagaaaccgcggcggcaatgatgcgtggtaacacgggccgtaagttgatgcaagattcaatcgaccgtgcgattcgtttccgtaaagagatcaaacgcttaaaaggtgaaagtgacggttggttctttgatgtttggcaaccagagaacattgagacaaccgaatgctggaaacttgaccctaaccaagactggcatggcttcaagaacatggacgatgaccacatgtatcttgacccaatcaaaatcactttgctgactcctggaatgagcaaagatggtgagttggaaaccagtggtattcctgcttcattggtggcgaaatatcttgatgaacgtggcattgtggtagaaaaaacaggcccttacaacttgttgttcttgttctcaattggtatcgacaaatcaaaagcgatgcaattgctacgtggtttgactgagttcaaacgtggttacgatctgaacctaacgattcgcaccatgctgcctgcgctgtaccgtgaagatccagcgttctacgaaggcatgcgtattcaagagctggcacaaggcattcacgatctgactcgtaagtaccgtctaccagaattgatgtacaaagcgttcgatgtgctaccagagatgaaagtcacgccacacgcagcttggcaacaagagcttcgtggtcaaaccgaagagatcttgctgaatgatatggtgggccgcgtgagtgccaacatgatccttccttaccctccaggtgtgcctctagtgctaccaggtgaagtggtgacagaaagctctcgtccagtactggatttcttggaaatgttgtgtgaaatcggcgcacattacccaggcttcgagaccgacatccacggcctataccgccaaaaagatggccgttacaccgtaaaagtactgaaagactga

SEQ ID NO: 883 - protein, 711 aa, Vibrio vulnificus; identical to SEQ ID NO: 331

SEQ ID NO: 884 - DNA, 2163 bp, Pasteurella multocida; identical to SEQ ID NO: 336
  CDS (1)..(2163)

SEQ ID NO: 885 - protein, 720 aa, Pasteurella multocida; identical to SEQ ID NO: 337

SEQ ID NO: 886 - DNA, 2139 bp, Moritella japonica
  CDS (1)..(2139)
atgaacattattgctattttaaaccacatgggcgtgttctttaaagaagagcctattcgtcaattacacaaatcgttagaagcatgtggatatgaagttgtttatccgcttgatgataacgacctagttaaaatgattgaaatgaatccacgtatctgtggtgctatctttgattgggataaatattctttagaattatgtgaaaaaattaataacttaaatgagaaacttccagttttcgcatttgcaaatgaacaatcagtacttgatatttcactcacagaccttcgcttaaatgtgtctttctttgaatatatgctaggtatgggtgatgatattgctctaaaaatcaatcaagcaattgacctttataaagatgaaataatgcctccatttactaaagcattatttaaatatgtagaagaaggtaagtatactttctgtacgccgggtcacatgggtggtactgcattccagaaaagcccagcaggtagtattttttatgatttttatggaccgaatgcttttaaagcggatgtatcaatctctatgcctgaattaggttcattattggatcactctggtccacataaagaagctgaagagtacattgcaaaaacatttaacgcagatcattcatatattgtaaccaatggtacttctactgcgaataaaattgttggtatgttctctgcaccatctggcagtactgtattagtagaccgtaactgtcataagtcattaactcaccttatgatgatgagtgatgttacacctatctacttccgcccgacgcgtaatgcatacggtattttaggtggtatcccacaaagtgaattcactcgtgaagttattgaagctaaagttgcagcaacaccgggtgctgaaatgccagattatgcagttatcactaactctacttatgatggcctgctttataacacgcaatttattaaagaaacactagatactaagtctattcactttgatagtgcttgggtaccatatactaactttaattctatttatgaaggtaagtgtggtatgagtggtgaagctatgccaggcaaggtgttctatgaaacacaatctacgcataaacttttagctgcattctctcaagcatcaatgatccacattaaaggtgaggttgataaagaaacctttaatgaagcatttatgatgcatacatcaacgtcaccacagtatggtatcgtggcatcagcagaaactgctgcagcaatgatgcgtggcaatactggcaaacgtttaattcaaggctctattgatcgtgctatccgtttccgcaaagaaattaaacgcttagaagcacaaagtgaaggttggttctttgacgtttggcaacctgaagatatcgaaacaacagaatgttggaagttagatccaaaagacgattggcatggctttaaagatattgatgataatcatatgtatcttgatccaattaaagtgacactattaacaccgggaatggggaaagatagcgaacttagtgagtctggtattcctgcagaacttgttgctaaattccttgatgaacgtggtattgttgtcgaaaaaacaggcccatacaacttattattcttgttctcaattggtattgataaagcaaaagcactggaattactacgtggactaacagaatttaaacgtggcttcgatcttaatctgaaagttaagagtttcttaccatcattatatgctgaagatccaagtttctatgaaggtatgaatattcaagatcttgctcaaggtattcataatatgattaagaagtttaagctacctgagctgatgtttaaagcgtttgatgtacttcctgaaatgaaggtcacaccgaacaaagcatgggaacaagaacttcgtggtaacacggaagaagttaaactagaggaaatggtaaatcgtgtaagtgctaatatgatcttgccgtaccctcctggtgtgccactaatccttcctggtgaaatggtaacagatacatcacgtccggtacttgaatttttagaaatgctatgtgagatcggtagtaagttccctggttttgaaacagatattcatggcgtataccttcaagatgatggtagctataccgttaaagtacttaaagaagattag

SEQ ID NO: 887 - protein, 712 aa, Moritella japonica; identical to SEQ ID NO: 329

SEQ ID NO: 888 - DNA, 1479 bp, Streptomyces coelicolor
  CDS (1)..(1479)
atgacagtcgatcaccgccgagcaccggtcctggaagccctcgtcgaataccgccgtgcgggacggctgtcgttcacgccgcccggacacaagcaggcgcgcggggcggaccccgcggtgcgcgaggtgctgggtgacgccgtgttccacggggacgtgctggcgacggccggactcgacgaccggctcacccggggacgggtgctgcagcgcgcccaggagctgatggcggacgccgtgcacgccgatcacaccttcttcacgacgtgcgggagttccctgtcggtgaaggcggcgatgctggcggtggcggggccgcacgagaagctgctgatcggccgggacgcccacaagtccgtggtctcggggctgatcctgtccggcatcgagccggtgtgggtcgaaccgcgctgggacgcggaacggcatctggcccatccgccgtccgccgagtcgttcgaggaggcgttcggggcgcatcccgacgccaagggtgccctgatcaccagcccgacgccgtacggggcgagcgccgatctgcgggccgtcgccgaggtgtgccacgggcgctcgctgccgctgatcgtcgacgaggcttggggggcgcatctgcctttccacccggatctgccgtcctgggcgatggacgcgggggccgacatctgcgtgaccagcatccacaagatgggcagcggtctcgaacagggctcggtgttccacctgcgcggcgacctggtgccgcccaagctgctcggtatgcgcgccgacctgctgagcaccaccagcccgtcggtgctgatcttcgccggtctcgacgggtggcgccgccagatggcgctcggcgggcaggagctgatgggcggcgcgctggagctggcggccggtgtccgggcggccgtcgaggagatcgacggcatgcacgtcaacgaccgcgaggacttctgcggtcccgggctggcccacggcttcgatccgctgccggtcgtcatcgacctcgaagggctcggtgtctcgggcttccgggcggcggactggctgcgggagcaccgcggtgtggtcgcccacctcaccgaccaccgccgtatcggcgcgcagatcacccacggcgacgaccgggggaccgccggcgaactgctcaccgccctcaaggacctcgccctcgccgcccccggcctgggatcggctccgggcgtcgaggtgccgtcgccggccgagctgcggatgcctcaggtgtgcctgccccgggacgcgttcttcggccccaccgaggacgtgcccctggaccgggccgccggccgggtcgcggcggagatgatcactccgtatccgcccggcattccggccgtgctgccgggcgagcggctggccgagccggtcctgcgctatctgcgcagtggcctggaggcggggatgtacctccccgacccgaccgatccggcgctggagacggtcagggtcgtcgcggagcacggtgcgtga

SEQ ID NO: 889 - protein, 492 aa, Streptomyces coelicolor; identical to SEQ ID NO: 357

SEQ ID NO: 890 - DNA, 2130 bp, Eikenella corrodens; identical to SEQ ID NO: 332
  CDS (1)..(2130)

SEQ ID NO: 891 - protein, 709 aa, Eikenella corrodens; identical to SEQ ID NO: 333

SEQ ID NO: 892 - DNA, 1443 bp, Bacillus subtilis
  CDS (1)..(1443)
atgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttctggggtgattaaggaagctcaggagcttgccagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttgtccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgccagccatgacgatgggttcttatttgcatctcaacagcagctgcaggattaacagggatcgggtggcagagtatttaaaccgattacaaagcagcagcccgtcttatccgattatggcttcgttagatattgcccgcgcttatgtacagcatattatagaagaacaaaagctttctgacattctgcagcggatagaaacacttaaacaaacgtttgattcacttacaaatgcagaagctgttaaccctgctaatccactgatcatcacggatccgctaaagctcacaattcgttcaaaacgcgggcattctggctatacgctgcaaagcattttagagcgtgccaacatattcactgagcttgctgatgaaaatcaagttctgctcgttctcccattgggaggaaaacggagaataaacgctgaaatcattagaagcatcgatgaagagattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggcttaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatga

SEQ ID NO: 893 - protein, 480 aa, Bacillus subtilis; identical to SEQ ID NO: 273

SEQ ID NO: 894 - DNA, 1452 bp, Synechocystis sp.; identical to SEQ ID NO: 266
  CDS (1)..(1452)

SEQ ID NO: 895 - protein, 483 aa, Synechocystis sp.; identical to SEQ ID NO: 267

SEQ ID NO: 896 - DNA, 23 bp, Primer
atgaacatcattgccattatggg

SEQ ID NO: 897 - DNA, 24 bp, Primer
ttatcccgccatttttaggactcg

SEQ ID NO: 898 - protein, 1269 aa, Artificial; identical to SEQ ID NO: 416
  consensus sequence
  misc_feature (1)..(302): Xaa can be any naturally occurring amino acid
  misc_feature (304)..(307): Xaa can be any naturally occurring amino acid
  misc_feature (309)..(322): Xaa can be any naturally occurring amino acid
  misc_feature (326)..(327): Xaa can be any naturally occurring amino acid
  misc_feature (329)..(359): Xaa can be any naturally occurring amino acid
  misc_feature (361)..(362): Xaa can be any naturally occurring amino acid
  misc_feature (364)..(367): Xaa can be any naturally occurring amino acid
  misc_feature (369)..(372): Xaa can be any naturally occurring amino acid
  misc_feature (374)..(377): Xaa can be any naturally occurring amino acid
  misc_feature (379)..(391): Xaa can be any naturally occurring amino acid
  misc_feature (393)..(407): Xaa can be any naturally occurring amino acid
  misc_feature (409)..(414): Xaa can be any naturally occurring amino acid
  misc_feature (417)..(417): Xaa can be any naturally occurring amino acid
  misc_feature (421)..(489): Xaa can be any naturally occurring amino acid
  misc_feature (492)..(492): Xaa can be any naturally occurring amino acid
  misc_feature (494)..(516): Xaa can be any naturally occurring amino acid
  misc_feature (518)..(518): Xaa can be any naturally occurring amino acid
  misc_feature (520)..(525): Xaa can be any naturally occurring amino acid
  misc_feature (527)..(591): Xaa can be any naturally occurring amino acid
  misc_feature (593)..(593): Xaa can be any naturally occurring amino acid
  misc_feature (596)..(601): Xaa can be any naturally occurring amino acid
  misc_feature (603)..(603): Xaa can be any naturally occurring amino acid
  misc_feature (605)..(606): Xaa can be any naturally occurring amino acid
  misc_feature (608)..(634): Xaa can be any naturally occurring amino acid
  misc_feature (638)..(638): Xaa can be any naturally occurring amino acid
  misc_feature (640)..(642): Xaa can be any naturally occurring amino acid
  misc_feature (644)..(656): Xaa can be any naturally occurring amino acid
  misc_feature (658)..(671): Xaa can be any naturally occurring amino acid
  misc_feature (673)..(759): Xaa can be any naturally occurring amino acid
  misc_feature (762)..(796): Xaa can be any naturally occurring amino acid
  misc_feature (798)..(799): Xaa can be any naturally occurring amino acid
  misc_feature (801)..(822): Xaa can be any naturally occurring amino acid
  misc_feature (824)..(917): Xaa can be any naturally occurring amino acid
  misc_feature (919)..(927): Xaa can be any naturally occurring amino acid
  misc_feature (932)..(936): Xaa can be any naturally occurring amino acid
  misc_feature (940)..(1269): Xaa can be any naturally occurring amino acid

SEQ ID NO: 899 - DNA, 840 bp, Saccharomyces cerevisiae
  CDS (1)..(840)
atgtcaaactacgaagccttgctgaaattcaataggaaggctgtatctaaggaaatggtgcaatatctagcatcgaccacagcttccattatcaaaattaagaagacgaatagtatgatagatattgcattgccagcaccaccgttgactaaattcatcaacagactgatcaagcattctaacgttcaaactccgactctgatggctacctctgtatatttggccaaattaagatcaataataccgagtaacgtttatggtatagagaccaccaggcatagaatattcttaggttgcctaatattagctgcaaaaacgttaaatgattcctcccctcttaacaaacactgggccgaatatacggacggccttctcatcctaagggaggttaatactattgaaagggaactattagaatattttgattgggacgtcaccatttccacagatgatttaattacatgtctctcgccattcttgaagcctatcaaagaggagcagttgtacaaatcgcaaagagactgtcgcacgttgaaaaatttttctgctcaagaaaaagacatagtaaacaaaacatccatttcccattcgcgctcatcgtccaatatgtctatcccatctttagcttccacttcgaccctctccacgttggaatctagaagatcgaatttatccaattatagtaacagaatacgaactttgcccgaactacacgaatccaataacattagcgacaagttttctccgcgaacatacaacatagactccaaacacgataacaaggaaataggccaataccgacaattaagccttttaattttagtaaagcgcgccctgtga

SEQ ID NO: 900 - protein, 279 aa, Saccharomyces cerevisiae
MSNYEALLKFNRKAVSKEMVQYLASTTASIIKIKKTNSMIDIALPAPPLTKFINRLIKHSNVQTPTLMATSVYLAKLRSIIPSNVYGIETTRHRIFLGCLILAAKTLNDSSPLNKHWAEYTDGLLILREVNTIERELLEYFDWDVTISTDDLITCLSPFLKPIKEEQLYKSQRDCRTLKNFSAQEKDIVNKTSISHSRSSSNMSIPSLASTSTLSTLESRRSNLSNYSNRIRTLPELHESNNISDKFSPRTYNIDSKHDNKEIGQYRQLSLLILVKRAL

SEQ ID NO: 901 - DNA, 840 bp, Saccharomyces cerevisiae
  CDS (1)..(840)
atgtgtgaatacagcaaggctcttcatattctgctcaagtcgccagtaacggatgacataataaaattcttaacagacacaacattgagggttgttccttcaagcaactaccccacgcctcccggttctccaggagagaaacacctcacaaggctgccatcgctaatgacttttatcactagattggtcagatacaccaacgtctacacacccactctgctcaccgctgcgtgctatttgaacaaattaaagcgtattctgcccagggacgctactggtctcccctcgaccatccatcgcattttcttggcctgtttgatactgagtgctaagtttcacaatgactcttctcctttaaacaagcactgggctaggtacaccgatggtctctttacactagaggatatcaaccttatggaaaggcagttgttacagctgttgaactgggacctcagggtgaacacagaagatttgatcctagatctgcagcctctattagagcccatcaagcaagacttggcaagatccagcgaccaaaggaagagaattaacatgatgatgtccatgaacagaaggacttgtgctggcacgagtcctatcagatcaaacaacagattcaaactctacgaaaaacagagaaacgtgtcgatagcatccgatttaagttctgctactctagtcgacagttgtaatgatctaagaaggctaaaagatgtaaccaacatagcgaacaacacagtcgctaacacgaattacgtcaggacggtagagaaatggaacgacaatgtcaacaggcaaagttgggatctggaacagatcatgagtcaacatgggttttaa

SEQ ID NO: 902 - protein, 279 aa, Saccharomyces cerevisiae
MCEYSKALHILLKSPVTDDIIKFLTDTTLRVVPSSNYPTPPGSPGEKHLTRLPSLMTFITRLVRYTNVYTPTLLTAACYLNKLKRILPRDATGLPSTIHRIFLACLILSAKFHNDSSPLNKHWARYTDGLFTLEDINLMERQLLQLLNWDLRVNTEDLILDLQPLLEPIKQDLARSSDQRKRINMMMSMNRRTCAGTSPIRSNNRFKLYEKQRNVSIASDLSSATLVDSCNDLRRLKDVTNIANNTVANTNYVRTVEKWNDNVNRQSWDLEQIMSQHGF

SEQ ID NO: 903 - DNA, 915 bp, Saccharomyces cerevisiae
  CDS (1)..(915)
atgatttctgactacgatgctcttttgcaattcaacaaaaaacctgtttcgcaagaaatgattcagttcttagccacttctactgcttccataattaaaatcagggaaaataataatccaatccaaggatgtcgcccaccagacttatctatcttcattaaaaacgtggtaattcagtcaaatgttcaaacaccaactttaatggccacatcagtctatttaaacaaactgaaaagcgtaataccaaaaaatgtgtacggtattaacaccacaagacatcggatatttctcggatgcttgatattagctgccaaaactctgaacgattcttctccctggaacaaacactggaccacgtacacagaaggtttactcagaatacgtgaggtgaataccatcgaacgagaactattagaatatttaaattgggatgtgaggataactacaccggatttgattgattctctttcttacttcctcgggcctatcaaggaacaactatttttacagaggagacaagaaatgctgttgttcaatgcaccaagtcccggccaactgaaagaatatataaatcatagaagaccggtttcgcattctagaacttcttctgctatatcggttccttcactgacatccatggcaacagtttcgacaacagactcaaggtcttctctactggcaaaataccaaccgtccctaccgttggtggaatctgacaacttcaacaaaaaaaatcatgtgccgttaaggaataataacgatatctgtaataatttcagggcagaggaaaacatacactcagtaaaccatattgatgtaacaatgggaagttcaccagtaatgtcgcataagcccacaattcaccaacggttaaattttacaaggaggggctggtcatcgtttttcaagcaataa

SEQ ID NO: 904 - protein, 304 aa, Saccharomyces cerevisiae
MISDYDALLQFNKKPVSQEMIQFLATSTASIIKIRENNNPIQGCRPPDLSIFIKNVVIQSNVQTPTLMATSVYLNKLKSVIPKNVYGINTTRHRIFLGCLILAAKTLNDSSPWNKHWTTYTEGLLRIREVNTIERELLEYLNWDVRITTPDLIDSLSYFLGPIKEQLFLQRRQEMLLFNAPSPGQLKEYINHRRPVSHSRTSSAISVPSLTSMATVSTTDSRSSLLAKYQPSLPLVESDNFNKKNHVPLRNNNDICNNFRAEENIHSVNHIDVTMGSSPVMSHKPTIHQRLNFTRRGWSSFFKQ

SEQ ID NO: 905 - DNA, 1182 bp, Neurospora crassa
  CDS (1)..(1182)
atgggtctaccatcatcaacgagcatgagcctcaacgagctcaatgcaaaggctctcgacaactttgtctacagcaaggtcgacagggacatgatcaggtttttggctaccgccgccagcgaggttatccaatgcgatcccaccatgatgccatcaccaacagtcgcggccacttctggaagggaacagcaacccacggcgccacccaaggttgtcaaatgtgaagatggcggactacctaccctcgaggccttcatcagccagcttgtcgtcagctccaacgtccaggttcccactctcatgtcgagtctggtctacctcagacgtctaaagtcccgccttcaacccaatgccaagggcctccgctgcaccacccatcgcatcttcctcgctgccctcatcttggccgccaagtatctcaacgacagcagtcccaagaacaagcactgggccagctacaccaacatgtcgagctccgcctacaactttggcttcagccgcaccgaggtcaacctgatggagaagcagcttctctgcctgttggattgggaactgcgcatcaccgaggaggatctctaccgcgagctggactacttcctggcccccatccgccgtgattacgaggtccgttatgcccgtcgcatgcgcgagaaggccgagaagcgccagcgccagttggaggaggaggcctgggtccaggttgccgctgccgccgccgccgcccagcacatccagcagcagcagcaacaacagcaacagcctacttacatctctcctccctcatcccgcggcagctcccgctcgcgcaacggttacgcctctcgcgacacctcgccacccggtctttccagctccgcatcttcgtacaccagctccaccagccgctcgacaacccccgacagcgaactggatcttcctcactcttacgttgccatcaacggcgacgactactaccagtctgctgctatcccgccttgcgtaccggagaaggatgccgcggccgtgtacttcagcaacacgcgcggcgctgccgtctccgccgccggtaccaagcggggtgttctcccctacgagattacggctgaggacctcgatgattccagcagggtgaagcgcatgcgcggcatgcttgggcgtgtgtttggcgctaacgctgaccggaacgttattccggtccggtaa

SEQ ID NO: 906 - protein, 393 aa, Neurospora crassa
MGLPSSTSMSLNELNAKALDNFVYSKVDRDMIRFLATAASEVIQCDPTMMPSPTVAATSGREQQPTAPPKVVKCEDGGLPTLEAFISQLVVSSNVQVPTLMSSLVYLRRLKSRLQPNAKGLRCTTHRIFLAALILAAKYLNDSSPKNKHWASYTNMSSSAYNFGFSRTEVNLMEKQLLCLLDWELRITEEDLYRELDYFLAPIRRDYEVRYARRMREKAEKRQRQLEEEAWVQVAAAAAAAQHIQQQQQQQQQPTYISPPSSRGSSRSRNGYASRDTSPPGLSSSASSYTSSTSRSTTPDSELDLPHSYVAINGDDYYQSAAIPPCVPEKDAAAVYFSNTRGAAVSAAGTKRGVLPYEITAEDLDDSSRVKRMRGMLGRVFGANADRNVIPVR

SEQ ID NO: 907 - DNA, 1263 bp, Emericella nidulans (Aspergillus nidulans)
  CDS (1)..(1263)
atggatctcaaccgaacagcgctgcaagagttcatcgcccagccggtctcgcgggacatggttgcttacctggcccagcaggctgcactggtcatccggtgcgagtctcatgtgacaacaactgcttccacacaaactgtgcatggccagcatacacctcccagcactccgccgatggatgctgctgatcagcagctcccaaggttgccgtcggtcgaagccttcattacctccctggtcactcgctcccaggtccaggtgccgacgctcatgacaaccctcgtctacctcgctcgtctgcgtgcccgcctacccccagttgcaaagggtatgcgctgcaccgtccaccgcatcttcgttgcctcgctcatcctggcggccaagaacctgaacgactcgagccctaaaaacaagcactgggcccgatacacagtcgttaagggctacgagggctttagcttctccctcccggagatcaacctgatggagcgccagcttctattcctgctggactgggacacccgcgtcactgaggcagacctcttcctgcacttggaacccttcctcgccccgatccgtcatcgtctccagcaacgagaagcgaagatgcaccaaccccgcgagtggcaccggttccaagcatccgcagagctgctagcctgccgtcttcgccggcaaaagctggaggcccgtctagaggcccgccgtcgactccctccaagcccgcagccctctgcctctctctcgtcagtgtcgtcttcttcaagtctgcaaagcgatgccgctgtatccgcacccgattctgatcggtaccagccctaccctcctcgtcgacgaccctccaaccgtagtcgtcactcagtgtcccccccttcgatccaggaaattcccggcttgtcacgcactgaaacagtacccacgctttgctcgcgctcatcaagcgttgctcccagtacaagaagcaacacaccggctagcctgcgaccgtctagctcatacaacagtatggaccaggaaattcaggttgtcgatgtatcgcgcagcccaggcctgagcagtggatacgtccaccttccttccagcactatgatggtcccgctccccgcagatgtggcaatggcaaaaggagacgacattgcggtgcagcagccgagcaagaaaatgcgaatgagcggccatagtggcagcagcggctttgtggcgcggttcttggcgtcggcgacgggaacctatatgggccaccggatgcggcctcgcgtttag

SEQ ID NO: 908 - protein, 420 aa, Emericella nidulans (Aspergillus nidulans)
MDLNRTALQEFIAQPVSRDMVAYLAQQAALVIRCESHVTTTASTQTVHGQHTPPSTPPMDAADQQLPRLPSVEAFITSLVTRSQVQVPTLMTTLVYLARLRARLPPVAKGMRCTVHRIFVASLILAAKNLNDSSPKNKHWARYTVVKGYEGFSFSLPEINLMERQLLFLLDWDTRVTEADLFLHLEPFLAPIRHRLQQREAKMHQPREWHRFQASAELLACRLRRQKLEARLEARRRLPPSPQPSASLSSVSSSSSLQSDAAVSAPDSDRYQPYPPRRRPSNRSRHSVSPPSIQEIPGLSRTETVPTLCSRSSSVAPSTRSNTPASLRPSSSYNSMDQEIQVVDVSRSPGLSSGYVHLPSSTMMVPLPADVAMAKGDDIAVQQPSKKMRMSGHSGSSGFVARFLASATGTYMGHRMRPRV

SEQ ID NO: 909 - DNA, 927 bp, Saccharomyces cerevisiae (Baker's yeast)
  CDS (1)..(927)
atgtcaaactacgaagccttgctgaaattcaataggaaggctgtatctaaggaaatggtgcaatatctagcatcgaccacagcttccattatcaaaattaagaagacgaatagtatgatagatattgcattgccagcaccaccgttgactaaattcatcaacagactgatcaagcattctaacgttcaaactccgactctgatggctacctctgtatatttggccaaattaagatcaataataccgagtaacgtttatggtatagagaccaccaggcatagaatattcttaggttgcctaatattagctgcaaaaacgttaaatgattcctcccctcttaacaaacactgggccgaatatacggacggccttctcatcctaagggaggttaatactattgaaagggaactattagaatattttgattgggacgtcaccatttccacagatgatttaattacatgtctctcgccattcttgaagcctatcaaagaggagcagttgtacaaatcgcaaagagactgtcgcacgttgaaaaatttttctgctcaagaaaaagacatagtaaacaaaacatccatttcccattcgcgctcatcgtccaatatgtctatcccatctttagcttccacttcgaccctctccacgttggaatctagaagatcgaatttatccaattatagtaacagaatacgaactttgcccgaactacacgaatccaataacattagcgacaagttttctccgcgaacatacaacatagactccaaacacgataacaaggaaaataggccaataccgacaattaagccttttaattttagtaaagcgcgccctgtgatcttgaaaactgggttaaacaaacagataataaaagaagatacaaaagtaaagaaatcgaattggtcaaattacttcaaatcgtga

SEQ ID NO: 910 - protein, 308 aa, Saccharomyces cerevisiae (Baker's yeast)
MSNYEALLKFNRKAVSKEMVQYLASTTASIIKIKKTNSMIDIALPAPPLTKFINRLIKHSNVQTPTLMATSVYLAKLRSIIPSNVYGIETTRHRIFLGCLILAAKTLNDSSPLNKHWAEYTDGLLILREVNTIERELLEYFDWDVTISTDDLITCLSPFLKPIKEEQLYKSQRDCRTLKNFSAQEKDIVNKTSISHSRSSSNMSIPSLASTSTLSTLESRRSNLSNYSNRIRTLPELHESNNISDKFSPRTYNIDSKHDNKENRPIPTIKPFNFSKARPVILKTGLNKQIIKEDTKVKKSNWSNYFKS

SEQ ID NO: 911 - DNA, 24 bp, Primer
atgtcaaactacgaagccttgctg

SEQ ID NO: 912 - DNA, 24 bp, Primer
tcacagggcgcgctttactaaaat

SEQ ID NO: 913 - DNA, 1182 bp, Saccharomyces cerevisiae
  CDS (1)..(1182)
atgtctagtgtaccttataattcccaacttcctatatccaaccatctagagtacgatgaagatgaaaagaagagcagaggctcaaaactaggcctgaaatataaaatgatatactggaggaaaactttatgcagttcgctagcgagatggagaaagctaatactattaatatctttagctttgtttttattcatatggataagcgattccaccataagcagaaatccatctaccacaagttttcaaggccaaaatagtaacgataataagttgagtaatactggttctagcatcaactccaaaagatatgtaccaccatattctaagagatcaagatggtcgttttggaatcaagatcctaggattgtcattatattagcggcaaacgaaggtggtggtgtattgaggtggaaaaatgagcaagaatgggctatcgaaggcatatcaatagaaaataagaaggcctatgcgaagagacatggatatgcgttgactatcaaggatttgacaacgtccaaaagatactctcacgaatacagagagggttggcaaaaagtagatatattgagacagacgttcagggagtttcctaatgcagaatggttctggtggttggacctggatactatgataatggagccttctaaatcattagaagaacatattttcgacagattggaaactctggctgacagagaattgaaaagttttaatcccctaaacctaagagacgacataccctatgtcgattattcagaggaaatggagtttctaataacacaagattgtggaggcttcaatttgggctcatttctgataaaaaatagcgaatggtctaagctgcttctagatatgtggtgggaccccgttctgtatgaacaaaaacatatggtttgggaacatagagaacaagatgcgttagaggcattatatgaaaacgaaccgtggattcgttcgagaataggatttttgcccttaagaacgatcaatgcattcccaccgggagcatgctctgaatacagtggtgactcaagatacttttacagtgagaaagaccatgattttgttgtgaatatggccggatgcaattttggcagagattgctggggcgagatgcagtactacaccactttaatggaaaaactgaataggaaatggtacacgagatttttcttcccataa

SEQ ID NO: 914 - protein, 393 aa, Saccharomyces cerevisiae
MSSVPYNSQLPISNHLEYDEDEKKSRGSKLGLKYKMIYWRKTLCSSLARWRKLILLISLALFLFIWISDSTISRNPSTTSFQGQNSNDNKLSNTGSSINSKRYVPPYSKRSRWSFWNQDPRIVIILAANEGGGVLRWKNEQEWAIEGISIENKKAYAKRHGYALTIKDLTTSKRYSHEYREGWQKVDILRQTFREFPNAEWFWWLDLDTMIMEPSKSLEEHIFDRLETLADRELKSFNPLNLRDDIPYVDYSEEMEFLITQDCGGFNLGSFLIKNSEWSKLLLDMWWDPVLYEQKHMVWEHREQDALEALYENEPWIRSRIGFLPLRTINAFPPGACSEYSGDSRYFYSEKDHDFVVNMAGCNFGRDCWGEMQYYTTLMEKLNRKWYTRFFFP

SEQ ID NO: 915 - DNA, 990 bp, Schizosaccharomyces pombe
  CDS (1)..(990)
atgctttccttttttacaaaaaataccttgactaaaaggaagcttattatgttagctttggctatagttttcaccttttttgccttcgggctatattttattccgcacgacgagatttctgtttttgattttaaacttcctgcacttcaatatgaaactacggtgacatctctcgataattttttgatcggcggaagcacaactttgtatacagcaaccgttaatcacgaagatctcaatgaaccaaaatcacatgaaatagtaatgcttcttgctagcgatggaaacgttggaagttttgaatctaacttactagatgattgctttaaaaatcgtatagagtatgcgaaacttcaaaactacaattttgaattcgttaacgtttccagtctggtagtgccacctgtatggggaaagatgcccgcaattctacaaacaatgcgcaagtatccatccgcaaaatggatctggtggctagatcaggatgctcttataatgaacaaaaatctgtccttacaggaattatttctctcacctgcaatgctccaaaaatcattgcttagggagcaaccaattataaactctttcggagaagataatttcagaatcactccagcggcttactccaaggaaatgatagaacaaatacaatttctaatttctcaggatcataacggattgaatgcaggaagctttttagtacgaaattcaagatccatcgctttactaatggatttattgactgatccttctttggcagatgcaggagtcgtgcgtcatgaacaagatttgatcggctatttcattcaaaaacactcgcaggtagcttccatggttggcattcttcctcaaagatttatcaatgcttttcatgaaggaccccctacaatgcaatggcaagaaggagatctagctcttcatttcgctggatgttgggttgaaaacaaatgcgccgagttatggactaaatacaaagataaaataatttaa

SEQ ID NO: 916 - protein, 329 aa, Schizosaccharomyces pombe
MLSFFTKNTLTKRKLIMLALAIVFTFFAFGLYFIPHDEISVFDFKLPALQYETTVTSLDNFLIGGSTTLYTATVNHEDLNEPKSHEIVMLLASDGNVGSFESNLLDDCFKNRIEYAKLQNYNFEFVNVSSLVVPPVWGKMPAILQTMRKYPSAKWIWWLDQDALIMNKNLSLQELFLSPAMLQKSLLREQPIINSFGEDNFRITPAAYSKEMIEQIQFLISQDHNGLNAGSFLVRNSRSIALLMDLLTDPSLADAGVVRHEQDLIGYFIQKHSQVASMVGILPQRFINAFHEGPPTMQWQEGDLALHFAGCWVENKCAELWTKYKDKII

SEQ ID NO: 917 - DNA, 1041 bp, Schizosaccharomyces pombe
  CDS (1)..(1041)
atggcacttatgttatccaggattccacgtcgtttttttttcttatttttaacggtcggcttgattgctggcgcgtttctatactcgttgatatattttgtggacgttgatttggtgtcgaaggttaaccagttgtatgatcagcaaattgcacccatgctctccgatgctattggcactccatccgttaatcactcgtttgagttggcgccgttagactctcatttggtggccacaagcactacattccacgaggcgtcatacgagtcagagcctcagcaaaatcctgccagtcaaaatattgtcttattactagttagtgatggacacacttcttacaataatggagctaatacgtttgaagaagctatacagaacagagttgactatagtaccaaacaaaactacaactttgagtatgtcaatgttactggcctccctattcccgccgtttggtccaagatgcccgccgtcttacaaactatgaagaaataccccaaagcggaatggatctggttgttggatcaggatgcaattattactaatacccatctttcccttcaagactcctttttgaaacctgagaacttgcaaaagaccttaattactaataccatcctcactaaacggcctataaatgctaacggggatttgcgttatacaccaagtaattatagtttaaaagatatcgaaaatctcatggtcataatctcacaggatcacaatggattaaacgcaggtagtatcttgttccgtaattcacctgctactgccttgtttttggatatttggacagatcctgttgttgcagaatgtgcgaaagccaataatgaacaagacatgcttggatatttgatttctaagcattcacaacttgcttcgctggttggccttattcctcaaagaaaaataaatgcttttcacgaaggtccggaaaatatggaatggcaaaaaggtgatttggtaattcactttgctggatgttgggttgaaaaccgctgcgatgaactatggcaaaagttttacgccttgattgactaa

SEQ ID NO: 918 - protein, 346 aa, Schizosaccharomyces pombe
MALMLSRIPRRFFFLFLTVGLIAGAFLYSLIYFVDVDLVSKVNQLYDQQIAPMLSDAIGTPSVNHSFELAPLDSHLVATSTTFHEASYESEPQQNPASQNIVLLLVSDGHTSYNNGANTFEEAIQNRVDYSTKQNYNFEYVNVTGLPIPAVWSKMPAVLQTMKKYPKAEWIWLLDQDAIITNTHLSLQDSFLKPENLQKTLITNTILTKRPINANGDLRYTPSNYSLKDIENLMVIISQDHNGLNAGSILFRNSPATALFLDIWTDPVVAECAKANNEQDMLGYLISKHSQLASLVGLIPQRKINAFHEGPENMEWQKGDLVIHFAGCWVENRCDELWQKFYALID

SEQ ID NO: 919 - DNA, 1269 bp, Saccharomyces cerevisiae
  CDS (1)..(1269)
atggcaatcaaaccaagaacgaagggcaaaacgtactcctcaagatcggtgggttcgcagtggttcaacaggcttggtttcaagcagaacaagtacggaacttgtaaatttttgtcgataataacggcctttgtttttatcctctatttcttctccaatcgcttctatccaatttctcgttccgccggtgcatcatattctccatcccatgggctgtatattaacgaaattcctgcctccagccggttgatttatccacatgtagaacatgtgcctgtgttaaaacaaatgaccgttaggggcctgtatattacgaggctagaagtggatggcagtaaaagattaattttgaaaccagaagagaatgctttgacagatgaagaaaaaaagaagactactgatcaaattctattagtgaagcactcgttcttagaccatggtaaattagtgtatcggaagagcaatgatgcacctgaagtggtcgtagtaaccctgatagattttgaaaactacgaattagaaacaattattcaaattgttcaaaatagggttgattacgctcaaaagcaccaatatggtgtatacattcgttggatacaggagtttttgcctgttcttgaaaatcagaatttggctgaaagctacgaattcattaagccattggtgataagagccgccatgcatgctttcccaactgccaagtatattcattttgttgatcaagatgctttattgatgaatctcgatctttctttacaaaaatacctgttagatccaaagattatggatttggctctattaaagaacgtccctgttgtggcgaattcaaacatcaagacatacaatcattttgaatatagttcggcaaagattatcattccacatgatgcgggtggtaatattgatgcgtcctcatttgttattgccaatgacttttatggtaaagctctgatagactacttgaatgatccgttactgagaaatttcccatgggataataccggtgataagttgagtgctgctatcggtcatattttacagtggcatcctacattactgggtaagacggcaatcgtcataccaaaagttttggcaagtcagtacgatgcatccttggatcaagaaggtgagtctggaaacggtgcttctaatggcgatgtttaccattataatgaaggggacttggctgcctccttcaagggatgtagatcaagaggtacgtgtgctagtgaaataggtcacatgtaccagaaaatcaagaaatcttag

SEQ ID NO: 920 - protein, 422 aa, Saccharomyces cerevisiae
MAIKPRTKGKTYSSRSVGSQWFNRLGFKQNKYGTCKFLSIITAFVFILYFFSNRFYPISRSAGASYSPSHGLYINEIPASSRLIYPHVEHVPVLKQMTVRGLYITRLEVDGSKRLILKPEENALTDEEKKKTTDQILLVKHSFLDHGKLVYRKSNDAPEVVVVTLIDFENYELETIIQIVQNRVDYAQKHQYGVYIRWIQEFLPVLENQNLAESYEFIKPLVIRAAMHAFPTAKYIHFVDQDALLMNLDLSLQKYLLDPKIMDLALLKNVPVVANSNIKTYNHFEYSSAKIIIPHDAGGNIDASSFVIANDFYGKALIDYLNDPLLRNFPWDNTGDKLSAAIGHILQWHPTLLGKTAIVIPKVLASQYDASLDQEGESGNGASNGDVYHYNEGDLAASFKGCRSRGTCASEIGHMYQKIKKS

SEQ ID NO: 921 - DNA, 999 bp, Schizosaccharomyces pombe
  CDS (1)..(999)
atggcagtcctacagtggaagttatctcgtgttatattcgtgttgttaatcattgggattagctcttttctcatttacttccaatttggaaactctttttctgcttcacctgctttagaacgtttacaagatgtattttccaaaccaagtgtacaagaatacgactacttagtacctctggatgaagatatgcaaggccttagcacgacgtatcatcaagcgacaattaacgaggatgatcctcaagagcccaaatcccatgaaatagtaatcctcttagcgagtgatggacgttcaagtggcaatatggcacctgaaacatttaatcaatgcatagaaaaccgaattaactacgcaaagcatcacaactatggctttgaatatgttaatgtaagccaaatgaacattcctccagtgtgggccaaaatgcccgctattatacaaacaatgaataagcatcctcatgcgaaatggatttggtggttggaccaagatgcgttaattttgaacacagaactctctattcaagaacatattttgtcacctgacgttttagtggaaaagttaatgaagaatgaacctatgatatctccatttagtgctgatctcgaacgtctcaccccaagttcctatactgttgacagtgctcgttctttagggctattgatttctcaagatttgaatggcttaaacgcgggaagtttctttgttagaaggtcgcccatgatggctctgtttttggacttatggggcgataaatcctttagagaaaataaggttgcggatcatgaacaggcccttttgggatattttgttagatatcacccggaaattgctgctataataggaattttacctcaaacccttattaattcttaccctgttggccagccggaaatgggctggaaagaaggtcatttggttatacattttgctgggtgttgggtggagaaccgttgtcaggttttgtgggatgaatatcgtgagagggttcattga

SEQ ID NO: 922 - protein, 332 aa, Schizosaccharomyces pombe
MAVLQWKLSRVIFVLLIIGISSFLIYFQFGNSFSASPALERLQDVFSKPSVQEYDYLVPLDEDMQGLSTTYHQATINEDDPQEPKSHEIVILLASDGRSSGNMAPETFNQCIENRINYAKHHNYGFEYVNVSQMNIPPVWAKMPAIIQTMNKHPHAKWIWWLDQDALILNTELSIQEHILSPDVLVEKLMKNEPMISPFSADLERLTPSSYTVDSARSLGLLISQDLNGLNAGSFFVRRSPMMALFLDLWGDKSFRENKVADHEQALLGYFVRYHPEIAAIIGILPQTLINSYPVGQPEMGWKEGHLVIHFAGCWVENRCQVLWDEYRERVH

SEQ ID NO: 923 - DNA, 1044 bp, Schizosaccharomyces pombe
  CDS (1)..(1044)
atgtggaaccccaaaaagaagtcagaagcattagctaagtttaaatcctttccttaccctaagccaggcacttccaatgtacttgattccaaagaaggtgatactagaaggaagtattttaccaagacgcatctacataggttattcgtctttgtggtactgttgctctgctcaggctactttttaaagcatacactcttgacgcgtcccaaagagagtaatgttgttatgatatttgtcaataacatcggaggtggcgttttagatgtaaaaagtcccagacaatgggagctggagaagatttcaacggagaacaagaagaaatacgctgaaaggcacggatatcatttctttgtgaagagcacaggcttaaagagacgatatgctcatgaatggcgtgaatcttgggaaaaagcagattatatcatggaagccatgaagaaataccctcatgctgaatggttttggtgggtcgatttaacaacattcatcatggaacctcaatattctcttgaaaagcttattattaacagacttgaccatattgcgaccaggaatattactgatagcatggagttcaatccaaaaaatttccacgaaattccatttgttgactatagtgaagatatcaactttattttagggcaagattgcaacggtttcagtttgggttcttttctggttcgtcgaagtgattggactagcagattgatggacttcctttgggatccagtagtctatgggcaaaagcacatggattggcctcacgatgagcaaaatgcaattgagtacttctacgagaataatgcttggcttcgaagcggcatgggattcgttcctcttcgccttttcaattcatatcctccaggtgcttgtgctggtgaaggtgaaaatcctcgtttcttttataaccaaaaagaaggagacttcttggtaaacttggcaggctgtaattatggaagggactgcctagatgaaataaatcattataagggattagcgcaaagaaaacggggttggaggaagttagttccgtttctttaa

SEQ ID NO: 924 - protein, 347 aa, Schizosaccharomyces pombe
MWNPKKKSEALAKFKSFPYPKPGTSNVLDSKEGDTRRKYFTKTHLHRLFVFVVLLLCSGYFLKHTLLTRPKESNVVMIFVNNIGGGVLDVKSPRQWELEKISTENKKKYAERHGYHFFVKSTGLKRRYAHEWRESWEKADYIMEAMKKYPHAEWFWWVDLTTFIMEPQYSLEKLIINRLDHIATRNITDSMEFNPKNFHEIPFVDYSEDINFILGQDCNGFSLGSFLVRRSDWTSRLMDFLWDPVVYGQKHMDWPHDEQNAIEYFYENNAWLRSGMGFVPLRLFNSYPPGACAGEGENPRFFYNQKEGDFLVNLAGCNYGRDCLDEINHYKGLAQRKRGWRKLVPFL

SEQ ID NO: 925 - DNA, 1128 bp, Schizosaccharomyces pombe
  CDS (1)..(1128)
atgcgttggtattcttatgttataccagcagtgatcctcagcataattgctatttctggagtatggtggaatgctacccttggtactaggctcgaccagaaagtacaacttttcttaaatgaacattcttcaattttgaatgcagtttacgaaacaactactatcgtttacacagagccattacacaccagtgtcagcgaaacgattacatctacgtcttttgttacagaaactacgacagtaaccccaacggttactgccacagctcaagagttaagcacacttaatcctcatcctgaaaattctaagatagtccttttgatgggttccaatgcccaaaatgacccttcctcacccttaaatccttatattagaacgattattaaaaatcgccgcgactatgcagaacgtcatggttttaagtttgaatttttagatttagatgagtacaaaccttcaattggcgacaagcctgccccttgggctaaaattcccatgattaaaaatgtgattagaaaatatccagatgctgaatgggtatggtggttggatcacgatgctttaattatgaatcgtgatttgaatctggttgatcacattttgaagcatgaaaagctaaattctcttttattgcgcgacaccgaatattttagtggatttggcattgactctgaaggattccgaacacctaaaaatcaagaccctgatgatatacattttatcattgctcaagattttaatggcattaatgctggcagttttttaataaggaattctgaagtaggaacatggatgctggatttttggaatgaaccactttataaagaacataatggtgtatttgtcgaacaacaagccctttctcatatgatatatagtcatcccattgtgcataaacatgttgggctagttactcttcgttcaataaacgcatatgattcttctgatcctgcttggggatatgaagacggtgatttatgtgttcattttgctgggtgctttgtctttcagacatgtgcacaaaattttgaaaagtatggcaagattatcacagaaaagcaaggccatgattggttcgatccatccgaaaaggaatatattgaacaacgccttttccctcaaccttaa

SEQ ID NO: 926 - protein, 375 aa, Schizosaccharomyces pombe
MRWYSYVIPAVILSIIAISGVWWNATLGTRLDQKVQLFLNEHSSILNAVYETTTIVYTEPLHTSVSETITSTSFVTETTTVTPTVTATAQELSTLNPHPENSKIVLLMGSNAQNDPSSPLNPYIRTIIKNRRDYAERHGFKFEFLDLDEYKPSIGDKPAPWAKIPMIKNVIRKYPDAEWVWWLDHDALIMNRDLNLVDHILKHEKLNSLLLRDTEYFSGFGIDSEGFRTPKNQDPDDIHFIIAQDFNGINAGSFLIRNSEVGTWMLDFWNEPLYKEHNGVFVEQQALSHMIYSHPIVHKHVGLVTLRSINAYDSSDPAWGYEDGDLCVHFAGCFVFQTCAQNFEKYGKIITEKQGHDWFDPSEKEYIEQRLFPQP

SEQ ID NO: 927 - DNA, 1056 bp, Schizosaccharomyces pombe
  CDS (1)..(1056)
atgttcaactttcgtttattttctcgtagaggaaaaagtttaggtctcttggccatcgttttattgctttttggcttttattctttaaagtcttcaatgcctgtttattccaattcgattggttctcccagtgcccattcctcttcatacaaaggtgtttctaaggcgaaaacatctccacaagatcctgattccgtagtcatgttgattgttagttttgacgaccattatgattcaagtagatctgactccagctctgtcttcctggataaagtgctttctgatcgtacagagtatgccttgcgtcatggctataccctagtccacaagaaagcccgcgatattcaagcgaggtatggtgtctatggtacttggagtattatcccagctttgagggaaactttggctgagtatcccgacgctggctggatatggttgctcgatgcaaaggctgttataatgaatccttccgaatctctcaaggatagggtcttgaaaccagaaaaactgtcgcagcatttgcttcttaattctccgatcgatccattaaagaactacatccgtacacgccgtaaaatggatccatctgatgtatttgtaattaccaccagtgattataatggaattagtacgcgttctttgcttattaaaaataacaactttgcgccatttcttttagatgcttggaatgaacctttgttgaaatccgccggttttgatcaagctgagcgatctgcgctatcccacttattggaagcacataacactatcttggatcatgttgcacttgtgtctcctaaagttttaaattcatacaccaactctgcggtcgatttgaattacgaagaaggtgatttcttggttattcttcaggactgtgagaacgctgctgcatgcgagcgtatattcgagtatgtattctatttatcatcttggtctcttgtatttttactaacacttccagcaactactatcaacagagaaaacttccagccattaaaaagcagctttcggaagaaacggttgatgaacaatcgtaggttagtactgtcttag

SEQ ID NO: 928 - protein, 351 aa, Schizosaccharomyces pombe
MFNFRLFSRRGKSLGLLAIVLLLFGFYSLKSSMPVYSNSIGSPSAHSSSYKGVSKAKTSPQDPDSVVMLIVSFDDHYDSSRSDSSSVFLDKVLSDRTEYALRHGYTLVHKKARDIQARYGVYGTWSIIPALRETLAEYPDAGWIWLLDAKAVIMNPSESLKDRVLKPEKLSQHLLLNSPIDPLKNYIRTRRKMDPSDVFVITTSDYNGISTRSLLIKNNNFAPFLLDAWNEPLLKSAGFDQAERSALSHLLEAHNTILDHVALVSPKVLNSYTNSAVDLNYEEGDFLVILQDCENAAACERIFEYVFYLSSWSLVFLLTLPATTINRENFQPLKSSFRKKRLMNNRRLVLS

SEQ ID NO: 929 - DNA, 1128 bp, Schizosaccharomyces pombe
  CDS (1)..(1128)
atgcggttcgctccttatttaattagtgctgttgtaattacaaccataatcctgggtggagcttggtggacttcagctatggataccaagcttcaaacgaagatgaaggagatcatcgaccaacacacgagtacttggaccccagtcgtttcctccgtaaccagtacccaaactgatactttacgtgttaccattagtgaagttgttagtgttactgccactttaaccgaaactttcactgctactccaactgtcacttctgtagttcatgctttagctaccactgatcctcatccggataactctaaaatcgtcattttgatgggctctaactttcaaaatgatgctaactctcctctccatcctttcgctcagtccattatcaaaaatcgtcgtgaatatgctgaacgccatggttacaaattcgaattcttagatgccgatgcctatgcttctcgtgttacaggtcatttaatgccctgggttaaggtccctatgcttcaagatacgatgaagaaatatcctgacgctgaatggatttggtggcttgatcatgacgcgttggtcatgaacaaagatcttaacgtcgtcgaccatgtgcttaagcacgaccgattgaataccattttaactagggaggctgaatataagagtggtgcaggtatccccgccgatggatttagaactccaaaggatcaggatgctaaggatgttcatttcatcatctctcaagattttaatggtattaacgctggcagtctttttattcgtaatagcgaagttggccgctggattgttgatttgtggtttgaacccttatatttggatcatattcagggatatgctgagcaacaagcgttttctcacatggtattttaccatccccaggtgtataaacatgtaggtgttgtcccacttaaggctataaacgcatatgattttgatgataatatttggggctatgacgacggggacttgtgtatccattttgctggatgtaactattttaagaattgtcccgagaagttccttaagtatgctcaaattttatcttctaaacaaggatccgattggatgtctgctcaagaaaaggatcatattcaaaatcttttgaaaccatcatcctag

SEQ ID NO: 930 - protein, 375 aa, Schizosaccharomyces pombe
MRFAPYLISAVVITTIILGGAWWTSAMDTKLQTKMKEIIDQHTSTWTPVVSSVTSTQTDTLRVTISEVVSVTATLTETFTATPTVTSVVHALATTDPHPDNSKIVILMGSNFQNDANSPLHPFAQSIIKNRREYAERHGYKFEFLDADAYASRVTGHLMPWVKVPMLQDTMKKYPDAEWIWWLDHDALVMNKDLNVVDHVLKHDRLNTILTREAEYKSGAGIPADGFRTPKDQDAKDVHFIISQDFNGINAGSLFIRNSEVGRWIVDLWFEPLYLDHIQGYAEQQAFSHMVFYHPQVYKHVGVVPLKAINAYDFDDNIWGYDDGDLCIHFAGCNYFKNCPEKFLKYAQILSSKQGSDWMSAQEKDHIQNLLKPSS

SEQ ID NO: 931 - DNA, 1044 bp, Schizosaccharomyces pombe
  CDS (1)..(1044)
atgtggaaccccacaaagaagtcagaagcattagctaagtttaaatcctttccttaccctaagccaggcacttccaatgtacttgattccaaagaaggtgatactagaaggaagtattttaccaagacgcatctacataggttattcgtctttgtggtactgttgctctgctcaggctactttttaaagcatacactcttgacgcgtcccaaagagagtaatgttgttatgatatttgtcaataacatcggaggtggcgttttagatgtaaaaagtcccagacaatgggagctggagaagatttcaacggagaacaagaagaaatacgctgaaaggcacggatatcatttctttgtgaagagcacaggcttaaagagacgatatgctcatgaatggcgtgaatcttgggaaaaagcagattatatcatggaagccatgaagaaataccctcatgctgaatggttttggtgggtcgatttaacaacattcatcatggaacctcaatattctcttgaaaagcttattattaacagacttgaccatattgcgaccaggaatattactgatagcatggagttcaatccaaaaaatttccacgaaattccatttgttgactatagtgaagatatcaactttattttagggcaagattgcaacggtttcagtttgggttcttttctggttcgtcgaagtgattggactagcagattgatggacttcctttgggatccagtagtctatgggcaaaagcacatggattggcctcacgatgagcaaaatgcaattgagtacttctacgagaataatgcttggcttcgaagcggcatgggattcgttcctcttcgccttttcaattcatatcctccaggtgcttgtgctggtgaaggtgaaaatcctcgtttcttttataaccaaaaagaaggagacttcttggtaaacttggcaggctgtaattatggaagggactgcctagatgaaataaatcattataagggattagcgcaaagaaaacggggttggaggaagttagttccgcttctttaa

SEQ ID NO: 932 - protein, 347 aa, Schizosaccharomyces pombe
MWNPTKKSEALAKFKSFPYPKPGTSNVLDSKEGDTRRKYFTKTHLHRLFVFVVLLLCSGYFLKHTLLTRPKESNVVMIFVNNIGGGVLDVKSPRQWELEKISTENKKKYAERHGYHFFVKSTGLKRRYAHEWRESWEKADYIMEAMKKYPHAEWFWWVDLTTFIMEPQYSLEKLIINRLDHIATRNITDSMEFNPKNFHEIPFVDYSEDINFILGQDCNGFSLGSFLVRRSDWTSRLMDFLWDPVVYGQKHMDWPHDEQNAIEYFYENNAWLRSGMGFVPLRLFNSYPPGACAGEGENPRFFYNQKEGDFLVNLAGCNYGRDCLDEINHYKGLAQRKRGWRKLVPLL

SEQ ID NO: 933 - DNA, 1413 bp, Magnaporthe grisea
  CDS (1)..(1413)
atgtcaccgtcacgaactccatcaccagttcccggtggaggctggtccagccccgggctcaacagcggtagatccagcccctcgaggggtgtggctggaagcacaggcggccacagtcccataatatgggagggttcccgggtgaaccagaacggcggctccggtaagggcggtccgtcgtctggcttcagggcgacgaatgcgggcaccaaccagcgcggcataatgggtcacgttcgcaggctgtcatctggtcttcccatgtggaacaacggcaagaccgtgaagtcggcatatagcaacaaggacaagggtgcgggtcagaagtggtacaaccccaacaggcttccgttggtggcccgggcaagaaggggctacgcgaggatgaacaggacggccaagaccgttctttgggctttggtgctgctgggcctttgtctttacgtcttttaccattctccactcgtgtatcattggaggagatcttcaatgctcggcggtggtgagaaggttgtcatcatcctcgcagccaacattggcggaggcgtcatggagtggaagggagctcgggagtgggcgatcgagagagacagcgttcgcaacaagaagaagtatgccgccacttggggctacgatcttgagattgtcgacatgagcaccaagaagcgatatgctcacgagtggcgtgagagctgggaaaaggttgactttatgaggagctgcatgaagaaataccccaaggctgagtggttctggtggttggacctcaacacctatgtcatggagccctcttactctcttcaagaacacatcttcgacaaccttcagcagcacgtctaccgcgatatcaacgagtacaaccccctgaacatcacccatcctcccaacgacccgttcctcgacgaggagtcccgcagcgccgtgggtgatggtcggcccgagtcggtcaacctgatcctctcgcaggactgctcgggcttcaacctgggctccttcttcatgcgacggagtgattggacagaccgcctgctcgacgtgtggtgggacccggtcgcctacgagcaaaagcacatggagtgggcacacaaggagcaggatgccctggagcagctgtacgttgcccttccgtgggtccgcaagcacactggattcctcccgcaacgcatgatcaacagcttcccgtcgggcgcctgttccgacaagggcccggacacgcgcatccactacgaccagaaggaccgagactttgtggtcaacatggccggctgtgagtggggtcgtgactgctggggagagatgtaccactaccgtgagctgagctactacctcaatcgaacctggtgggagcgtttcaaggaggacctcctctgcgccatctggttcaagctcaccggtcagaaggtcaagttctga

SEQ ID NO: 934 - protein, 470 aa, Magnaporthe grisea
MSPSRTPSPVPGGGWSSPGLNSGRSSPSRGVAGSTGGHSPIIWEGSRVNQNGGSGKGGPSSGFRATNAGTNQRGIMGHVRRLSSGLPMWNNGKTVKSAYSNKDKGAGQKWYNPNRLPLVARARRGYARMNRTAKTVLWALVLLGLCLYVFYHSPLVYHWRRSSMLGGGEKVVIILAANIGGGVMEWKGAREWAIERDSVRNKKKYAATWGYDLEIVDMSTKKRYAHEWRESWEKVDFMRSCMKKYPKAEWFWWLDLNTYVMEPSYSLQEHIFDNLQQHVYRDINEYNPLNITHPPNDPFLDEESRSAVGDGRPESVNLILSQDCSGFNLGSFFMRRSDWTDRLLDVWWDPVAYEQKHMEWAHKEQDALEQLYVALPWVRKHTGFLPQRMINSFPSGACSDKGPDTRIHYDQKDRDFVVNMAGCEWGRDCWGEMYHYRELSYYLNRTWWERFKEDLLCAIWFKLTGQKVKF

SEQ ID NO: 935 - DNA, 1305 bp, Neurospora crassa
  CDS (1)..(1305)
atgtcgctgtcccgcagtccttctcccgttcccggtggtggctgggcaagtccaggccttacaaacaacctcagcccgagcggtcgatcgagtcctaccaaggcctacgccggatccaacgggacgcccgtcatgtgggaaaggcaaaaaaacatgggcggcgccgcataccagtccttctcgacacagaaccagggcttctttagccgccacatgcgtcggatatcaagttcgctgccccgattcaaggccgacaacacccatggcgccgagagagagaagattggccaaggtcgatggaacatgccacgactcggcaggatacgaggcatcacggggaggatgagcaggaggaccaagatgctgctagcctttgccctcttgttcctgctcggatacatcatcttttacagcactcctgccaacgttggcggtggtgtcatggagtggaagggcgccagggaatgggcaatcgagagggactcgattcgcaacaagaagaaatacgttgccaagtggggatacgatctcgagattgtcgacatgagcacaaagaaacgctatgcgcatgaatggcgcgagagctgggaaaaggttgatttcatccgctccactctgcgaaagtatcccaaggcagaatgggtttggtggcttgacctcaacaccttcattatggagccatcgaagtctctgcaggaccatattttcgaccacatcgaggatgtcacctaccgcgacatcaatgagtacaatccgttgaacatctctcaccccccggccgacccttacctcgacgaactctcgaaaagtccgattggagatggcaacccgaactcgattcacctcatgttgtcgcaggattgctctggattcaatttgggttccttcttcatgcgccgcggcacttggacggatcatttacttgatgtttggtgggatcctgtggcatacgaacagaagcacatggagtgggaacacaaggagcaagatgccttggagcagctttacactgcgcaaccttggattcggaagagtacggccttccttccgcagcgcatgatcaacagtttccctacaggcgcctgctctgaaaagggcactgatccgcgcatacattacgaccagaaggatcgggatttcctggtcaacatggccggatgtgaatggggccgagactgctggggtgagatgtacaacttccgcgagctgagctatcacctcaaccggtcgttgtgggaacgattcaaggaggacctcctttgctggatctggttcaagttgaccggaaagaaggtcaagttctaa

SEQ ID NO: 936 - protein, 434 aa, Neurospora crassa
MSLSRSPSPVPGGGWASPGLTNNLSPSGRSSPTKAYAGSNGTPVMWERQKNMGGAAYQSFSTQNQGFFSRHMRRISSSLPRFKADNTHGAEREKIGQGRWNMPRLGRIRGITGRMSRRTKMLLAFALLFLLGYIIFYSTPANVGGGVMEWKGAREWAIERDSIRNKKKYVAKWGYDLEIVDMSTKKRYAHEWRESWEKVDFIRSTLRKYPKAEWVWWLDLNTFIMEPSKSLQDHIFDHIEDVTYRDINEYNPLNISHPPADPYLDELSKSPIGDGNPNSIHLMLSQDCSGFNLGSFFMRRGTWTDHLLDVWWDPVAYEQKHMEWEHKEQDALEQLYTAQPWIRKSTAFLPQRMINSFPTGACSEKGTDPRIHYDQKDRDFLVNMAGCEWGRDCWGEMYNFRELSYHLNRSLWERFKEDLLCWIWFKLTGKKVKF

SEQ ID NO: 937 - DNA, 975 bp, Neurospora crassa
  CDS (1)..(975)
atgcatttcgcataccctccacgaaaatcttcgaacccgccgccttttcggcctcggacgtccgctcttccaacaatacgaggcaagcgtttgaaaaccatcgtccttatcggcctggcattcctgacgctactctggctattccaacgaggcggccgtagtcgacatgcgccaccggcgtaccacaagccgtcgggcaacccgccggtggtgatagtcacggtgttcaatgagggcaaatatggaaaggggtatttagatatggtcaaggaaaacaggttaaaatatgccgagaagcacgcttacttaccatcatcaccacccgatccaggctacggcaccttcttcgtcaaatcctccgactacgacctccgcggcgcacccgtctcgtgggccaccctccccgccgtccgacatgccatgactgagttccccgatgcgtcatacatctggtatctcgatcagaacgccttcatcatgaacccgcagctgaagatcgaggagcacgtcatgaagccatcgaggctggaggagctgatgatcaaggaccaccccgtcgtgccgcccgacagcatcatcaagacgttcagccacctcaagggacacgatgttgatttcgtattgacgcaggacaaggatggcctgtcttcgagcagcttcgtggtgaagaatggcgagtgggccaagtttttcctcgagacttggtttgatcccatctacaggacttataactttcagaaggcggagcagcatgccttggaacacattgtccagtggcatcccaccatcctcgccaagctcgctcttgtgccccagcgcatcttgaactcatacagtaaggagaagggtgggcaggagtacaaggagggagaccttgcggtgcgcctctatgcttgcggtgaagctggcgaggatacttgtgagaccgagtcgcaaaggttcgctcagtggaaggccgcgtatcaggactcatga

SEQ ID NO: 938 - protein, 324 aa, Neurospora crassa
MHFAYPPRKSSNPPPFRPRTSALPTIRGKRLKTIVLIGLAFLTLLWLFQRGGRSRHAPPAYHKPSGNPPVVIVTVFNEGKYGKGYLDMVKENRLKYAEKHAYLPSSPPDPGYGTFFVKSSDYDLRGAPVSWATLPAVRHAMTEFPDASYIWYLDQNAFIMNPQLKIEEHVMKPSRLEELMIKDHPVVPPDSIIKTFSHLKGHDVDFVLTQDKDGLSSSSFVVKNGEWAKFFLETWFDPIYRTYNFQKAEQHALEHIVQWHPTILAKLALVPQRILNSYSKEKGGQEYKEGDLAVRLYACGEAGEDTCETESQRFAQWKAAYQDS

SEQ ID NO: 939 - DNA, 996 bp, Kluyveromyces lactis (Yeast)
  CDS (1)..(996)
atgacttcgagtacaccttatgagtactcatacgaattggatgagaaaaagccattaaatttggattccaattacgtgtcgtcattttcaaaatataagaggtacgtcctatggctgttttccatacttttcatattattttggttaagtgatttctcacttgttgcagctgaacccaaggtggtgataattgttgctgtcaatagtggtggcggtggtgttttaaagtggaaatcggaacaagaatgggctatcgagcgtatttctatcgaaaacaaacgtgcatacgccaaaagacatggttacggattgttcattaaagatcaggcactatcaaagagatactcccatgaatacagagagggctggcaaaaggttgatataatgaaacagactatgagggaattccccaatgctgaatggttttggtggttagacgtggaaactcttatcatggagccccaactttctttggaagaacatatcttcgatagactagatgaaatcgcaaacaagactttggaagctttcaatcctttgcatatagctaccgatgtggcatatgttgactattcacaaccgtcagatatgttaattacacaggactgtggtggttttaatttgggttctttcctaatgagaaacactgaatggactgagcttcttctcgatatatggtgggacccagtcggatatgaacaaaaacatatggtctgggaacatcgtgaacaagacgctttagaagcattgtatgctaacgaaccttggattagagagaagatcgcatttctaccactaaggcagatcaatgctttcccaccaggtgcttgtgcagatttcaagatagacttgcgctatttctataacgaaaaggaacatgacttcgttgtgaatatggctgggtgtaactttggtagagactgctggggtgaaatgcgccaatacactcaactgatgcaaactcttcaccgtagatggtactcgatgttcttttag

SEQ ID NO: 940 - protein, 331 aa, Kluyveromyces lactis (Yeast)
MTSSTPYEYSYELDEKKPLNLDSNYVSSFSKYKRYVLWLFSILFILFWLSDFSLVAAEPKVVIIVAVNSGGGGVLKWKSEQEWAIERISIENKRAYAKRHGYGLFIKDQALSKRYSHEYREGWQKVDIMKQTMREFPNAEWFWWLDVETLIMEPQLSLEEHIFDRLDEIANKTLEAFNPLHIATDVAYVDYSQPSDMLITQDCGGFNLGSFLMRNTEWTELLLDIWWDPVGYEQKHMVWEHREQDALEALYANEPWIREKIAFLPLRQINAFPPGACADFKIDLRYFYNEKEHDFVVNMAGCNFGRDCWGEMRQYTQLMQTLHRRWYSMFF

SEQ ID NO: 941 - DNA, 25 bp, Primer
atgtctagtgtaccttataattccc

SEQ ID NO: 942 - DNA, 25 bp, Primer
ttatgggaagaaaaatctcgtgtac

SEQ ID NO: 943 - DNA, 372 bp, Saccharomyces cerevisiae
  CDS (1)..(372)
atgaatattaattattattattgttataaatctatatgctcgtggatttttttaaataaattagacttacctgttatttacaagacttcttcgtttgacattagtccggcctgtgattctatgtcttgctcacctgcaatagcccgcgtagaaaaaagccttgaccaaaaattcccaatcgaaaatttggacttgaaatctgaaatcccatgtgattcaatatccggtggagtccacttcttcaacatcaatgaacttagaacgacactgaccgagctgaatgccatcgctaaaccggcgagcattggaggaagagttatgccccaaggaatgagcacacccatagcaatcggaatcatgaatatattatag

SEQ ID NO: 944 - protein, 123 aa, Saccharomyces cerevisiae
MNINYYYCYKSICSWIFLNKLDLPVIYKTSSFDISPACDSMSCSPAIARVEKSLDQKFPIENLDLKSEIPCDSISGGVHFFNINELRTTLTELNAIAKPASIGGRVMPQGMSTPIAIGIMNIL

SEQ ID NO: 945 - DNA, 32 bp, Primer
atgaatattaattattattattgttataaatc

SEQ ID NO: 946 - DNA, 27 bp, Primer
ctataatatattcatgattccgattgc

SEQ ID NO: 947 - DNA, 1980 bp, Saccharomyces cerevisiae; identical to SEQ ID NO: 13
  CDS (1)..(1980)

SEQ ID NO: 948 - protein, 659 aa, Saccharomyces cerevisiae; identical to SEQ ID NO: 14

SEQ ID NO: 949 - DNA, 26 bp, Primer
atggatagtacgaatttgaacaaacg

SEQ ID NO: 950 - DNA, 26 bp, Primer
ttagagtatttccagatctgaatctg

SEQ ID NO: 951 - DNA, 1041 bp, Saccharomyces cerevisiae
  CDS (1)..(1041)
atgtcaggtgtaagctctgttatgctcggtcttcgacctgctacaagaatttttttccgcagtaatatttcggtttcaccttcgaggacttttgtatcatatattggaagatcccagagcacgtcgatactcaaaaatgctcccaacttagaggacaatgtcacaaatcttcagaaaattataccgaaacggttcttttctcaaacatcaattttgaaatcaaggtggaagcctatattcaatgaagaaactactaatcgatacgtacgtttgaacaggtttcagcagtaccagcagcagagaagcggcggcaatcctctgggctctatgactattttggggctctctttaatggcaggaatatattttggctccccttatttgttcgagcacgttccaccctttacgtattttaagacgcatccaaagaatctggtatacgcgttattaggcatcaatgttgccgtatttggactatggcagctacccaaatgctggaggtttctacagaagtacatgttgctgcaaaaggattacgtaactagcaaaatttcgataatcggaagtgcgttttcacatcaagaattctggcacttaggtatgaacatgctagcgttgtggtcctttggtacttcactcgcaacaatgttgggagcatccaattttttctccttatatatgaatagtgccattgcaggttctttgttttcgttatggtatccaaaactggcacgcctagccattgtcggacctagcttgggtgccagtggagcgctatttggggttttaggatgtttttcatatctattcccacacgctaaaattttgctgtttgttttcccagtcccaggtggggcttgggtagcattcttggcttcagtggcatggaatgcagctggttgtgctttaagatgggggtcatttgattacgctgcgcatttaggtggctctatgatgggggtcttgtacggatggtatataagtaaagctgtagagaaacaaaggcagcgtcgccttcaggctgctggtaggtggttttaa

SEQ ID NO: 952 - protein, 346 aa, Saccharomyces cerevisiae
MSGVSSVMLGLRPATRIFFRSNISVSPSRTFVSYIGRSQSTSILKNAPNLEDNVTNLQKIIPKRFFSQTSILKSRWKPIFNEETTNRYVRLNRFQQYQQQRSGGNPLGSMTILGLSLMAGIYFGSPYLFEHVPPFTYFKTHPKNLVYALLGINVAVFGLWQLPKCWRFLQKYMLLQKDYVTSKISIIGSAFSHQEFWHLGMNMLALWSFGTSLATMLGASNFFSLYMNSAIAGSLFSLWYPKLARLAIVGPSLGASGALFGVLGCFSYLFPHAKILLFVFPVPGGAWVAFLASVAWNAAGCALRWGSFDYAAHLGGSMMGVLYGWYISKAVEKQRQRRLQAAGRWF

SEQ ID NO: 953 - DNA, 672 bp, Nostoc sp. PCC 7120
  CDS (1)..(672)
atgtttcccctctacgacgaaaatccgacgcgaatcaccccctatttcacctacggtttaattgggatgaacgttttagtttttcttcacgaagtgagtctgtctaatgctcaattaaatcagtttttcagtcagtatgcagtagtccctcaagagttaacctccaatttagctggtgaatggccgacgttattcacctcgcaatttttgcacggtggttggtggcatttgatatcgaatatggtgtttctttgggtgtttggcaacaatattgaagaacgcctggggcatttcaaatatttaattttttatttggcttgtggtgctttagctgccttgtgtcagtggtttattggtatgtcttccaccattccttccttgggtgctagtggtgccatttccggggttctcggtgcatacctgattcgttttccccaagctagggtgacaacgttaattttcttaggtttctttgtaacaacaatcagtgttccagccctagtgattatcggcattttctttgtgcaaaatgttatatccggtcttgtcagcctacaagcagccgctaacatgagtgtacaaacagggggtgtcgcttattgggcgcacattggtggttttgtgtttggcataattcttgcccctatatttggtttgtttagacgggactaa

SEQ ID NO: 954 - protein, 223 aa, Nostoc sp. PCC 7120
MFPLYDENPTRITPYFTYGLIGMNVLVFLHEVSLSNAQLNQFFSQYAVVPQELTSNLAGEWPTLFTSQFLHGGWWHLISNMVFLWVFGNNIEERLGHFKYLIFYLACGALAALCQWFIGMSSTIPSLGASGAISGVLGAYLIRFPQARVTTLIFLGFFVTTISVPALVIIGIFFVQNVISGLVSLQAAANMSVQTGGVAYWAHIGGFVFGIILAPIFGLFRRD

SEQ ID NO: 955 - DNA, 720 bp, Nostoc sp. PCC 7120
  CDS (1)..(720)
atggttcccattagagataataatcctgtaacaattacgccttatgtgacttatgggctaattgctgccaatatcctcgcttttttgtatgaagctaatcttcctccccaagcattggatggctttttgcatttggcggctgtcgttccgcgagaactgagtttaagttttgctggtgtttctgtgcatcaaccagtaccagagtgggcaactttgattacctcccaatttctccacggtggttttctgcacctagctgggaatatgttgttcctatggatttttggtaacaacgtagaagaaaaacttggtcatgccagatatttgctgttttatctagcgtgcggcatattagcgtctttaagccaatggtacttctcccaagattctagcattccttctttgggtgctagtggggcgatcgctggtgtgatgggtgcatatattctgcgttttcccaacgccgaaattctcggtgttgtccctttaggtttcttcttcccaactttccgtgttcctgcatacttctttttaggtttttggttcctgcaacaatctttttacggacttgctggtttacaaacacgcactaacatcgggatggaaagtggtggtattgcctattgggcccatgctggtggttttattttcggcgcactcctggggcccttgttgggtctatttagcgataaagccaaggaagaatcttggtatagttaa

SEQ ID NO: 956 - protein, 239 aa, Nostoc sp. PCC 7120
MVPIRDNNPVTITPYVTYGLIAANILAFLYEANLPPQALDGFLHLAAVVPRELSLSFAGVSVHQPVPEWATLITSQFLHGGFLHLAGNMLFLWIFGNNVEEKLGHARYLLFYLACGILASLSQWYFSQDSSIPSLGASGAIAGVMGAYILRFPNAEILGVVPLGFFFPTFRVPAYFFLGFWFLQQSFYGLAGLQTRTNIGMESGGIAYWAHAGGFIFGALLGPLLGLFSDKAKEESWYS

SEQ ID NO: 957 - DNA, 774 bp, Agrobacterium tumefaciens
  CDS (1)..(774)
atgttcataccgctgcacgatgcgaatttcctcaaacatatccggctgcaatatgtgaccatcggcctgatcgtgatcaatgtactggtctggctgtttaccggcgtgcttgccagcgacgtgcaggccaatgccgcagcgctcggcctcggtttcatccctgccgtggtattcgattacgcctatctggaaccggccctgcaggtggtgcctgatgatctcaccgtcgtcacctatgcgttcctgcatctcgatttctggcatctggccggcaacatgctgtttctctgggtcttcggcgacaatgtcgaggatgcgctcggtcacttccggttcctgatcttctacctcgtctgcgcgattgccggcgccctgtttcacggctttgtcgcccccacttcggaagggccgctgatcggtgcatcgggtgcggtttccggtgtggttgcggcctatttcctgctgcatccaagggtacgtgtctgggtgctggtcctgatgcgcattccacttcccctgcccgccttcattccgttggcgctgtggatcggtcagcagttcctgatgctggcgctggggctggagcaaaacgtttcctggggcgcgcatgtgggtggcatcctggcgggcgcgatcatggtgattttcatgcgcaggccggatgttcccctgtttgaccgcaccattgttgcgccgagggcggcgcagttcaagaatacgtcgcaaacggcagggttgtcgcaaatcgaacggggctatgacgggggtagatga

SEQ ID NO: 958 - protein, 257 aa, Agrobacterium tumefaciens
MFIPLHDANFLKHIRLQYVTIGLIVINVLVWLFTGVLASDVQANAAALGLGFIPAVVFDYAYLEPALQVVPDDLTVVTYAFLHLDFWHLAGNMLFLWVFGDNVEDALGHFRFLIFYLVCAIAGALFHGFVAPTSEGPLIGASGAVSGVVAAYFLLHPRVRVWVLVLMRIPLPLPAFIPLALWIGQQFLMLALGLEQNVSWGAHVGGILAGAIMVIFMRRPDVPLFDRTIVAPRAAQFKNTSQTAGLSQIERGYDGGR

SEQ ID NO: 959 - DNA, 993 bp, Archaeoglobus fulgidus
  CDS (1)..(993)
atgctcctacactctttctctcgatttaagcttttgcggggatttttatctctcgccgctgcgaattatgcgatgaaacatctaccgctgttttctacggcagtggaaaacttcgcactattcccaaggctccccaactcaacccaagccgaagcctttttaacttcccgctccttaatgctgagagtggcaagatgtgatgtttgcggtgaggaggttacaatccccttcaaatgtaagtactgcggcggaaccttctgcgcagagcacaggctgcccgagaaccacgattgcgacgggctggatgaatactggaatgttcccgttaatgttaagcggaggttgagcccccagcctgcaagaaggagcaggaacattggattgatgaagtatggggcaaacaacaccgtcctcataatctgcacgattctcttcttcatctcaatcgttgctccctacgagatggttgagattttcgccctccatccccgacttgatgttctgctagctatgccctggcagcttatcaccagcatgttcctccacgtggagttctggcacttcttcgtcaacatgttcgtcctgcttttcttcggaactgagcttgagaggaggcttggtgacagaaagtacctcgaaattttctttgtctcaggccttgcggggaatgtaggatacatagcctactcctacgctgttggaagctttgccccagctctcggagcatctgcagcgattttcggtgtaatgggctgccttgccataattgcccccgaaatcaggataataatcttcccgattccgattcccatcaacataagaaccgccctcctgcttttcgccgcctacgacttctggatgatggttgccagctatatggggcttttctacaccaatgtcgccaacatagcccaccttgcggggctggctgtgggcctctactacgggaaaaggctcggaaggagaaaggtgaggtatgacttctacttctaa

SEQ ID NO: 960 - protein, 330 aa, Archaeoglobus fulgidus
MLLHSFSRFKLLRGFLSLAAANYAMKHLPLFSTAVENFALFPRLPNSTQAEAFLTSRSLMLRVARCDVCGEEVTIPFKCKYCGGTFCAEHRLPENHDCDGLDEYWNVPVNVKRRLSPQPARRSRNIGLMKYGANNTVLIICTILFFISIVAPYEMVEIFALHPRLDVLLAMPWQLITSMFLHVEFWHFFVNMFVLLFFGTELERRLGDRKYLEIFFVSGLAGNVGYIAYSYAVGSFAPALGASAAIFGVMGCLAIIAPEIRIIIFPIPIPINIRTALLLFAAYDFWMMVASYMGLFYTNVANIAHLAGLAVGLYYGKRLGRRKVRYDFYF

SEQ ID NO: 961 - DNA, 1011 bp, Arabidopsis thaliana (mouse-ear cress)
  CDS (1)..(1011)
atgaaggcgatcttcaaccgtagagttgtcgtcgactcatcttcgcgtctcaccaagctgctcgcgaatccaactactcattctcacctgaatcgtcaaactttcacttctctctataaaccaaaccagagccgccattttcgaacacactatcttccttcaagcccgtcgtctcctcccgtgagccgctttgacccttctcagctatggcgatcggagaaaattcgtgggtttttcgcgagcgctttagggaacaaagctgtgaaattgggaaatctcgtggaatccagagttgggttcattggttctcagtttcccaaaaagggtttcgaattccagaggttttctgggtttcaaaggcgtggctggaagcattggcttcaagggttatcagatcgtgacgttgttcttgggttagttatagctaatgctggtgtgtttgtgatgtggcgtgttttcaatcaacaattcatgatgaataacttcatgatatcgttggataatttcaagagtgggcgtctacacactctgataacttcagcattcagtcatattgatattggacatatcgtctcaaacatgattggactctacttttttggaaccagtatcgctagaaactttggtcctcagttccttttgaagctgtaccttgctggagcccttgggggctctgttttctacttgattcaccatgcttatatggctgcaacatcgcccaagggtcaaggagctttcgtgagggatccatcgagaaccccgggactgggcgcgagtggagccgtgaatgccatcatgctgctcgatatcttcctgcacccaagagctactctatacttggaatttttcattccagttccggcaatgttgcttggtatctttctcataggaaaagacattttaaggataacagaggggaacagtaacatatcaggttcagctcatttgggaggagctgcagttgcagccatcgcctgggctcggattaggaaaggccgtttccgcttttga

SEQ ID NO: 962 - protein, 336 aa, Arabidopsis thaliana (mouse-ear cress)
MKAIFNRRVVVDSSSRLTKLLANPTTHSHLNRQTFTSLYKPNQSRHFRTHYLPSSPSSPPVSRFDPSQLWRSEKIRGFFASALGNKAVKLGNLVESRVGFIGSQFPKKGFEFQRFSGFQRRGWKHWLQGLSDRDVVLGLVIANAGVFVMWRVFNQQFMMNNFMISLDNFKSGRLHTLITSAFSHIDIGHIVSNMIGLYFFGTSIARNFGPQFLLKLYLAGALGGSVFYLIHHAYMAATSPKGQGAFVRDPSRTPGLGASGAVNAIMLLDIFLHPRATLYLEFFIPVPAMLLGIFLIGKDILRITEGNSNISGSAHLGGAAVAAIAWARIRKGRFRF

SEQ ID NO: 963 - DNA, 894 bp, Streptomyces coelicolor
  CDS (1)..(894)
atggaccacgcggcggccggccgaccggatgcccagagcctgcccggctgctatcgccatccggaccgcgagaccggcatccgctgcacccgctgcgagcgccccatctgcccggactgcatggtcaacgcctccgtcggcttccactgccccgactgcgccgccggccgcacacccggcgccaccggcccggccccgggcgcctcccggccccgcaccctcgcgggcggcaccgtcgcggcagacccgcacctcgtcaccaagatcctgatcgggatcaatgtggcggtgttcatcgccgtccaggcgctcccgtcgtccttcctcagcgacatggtgctcatcggacgctggccccccgcccccttcgtcccgaccgagggcgtcgcggagggcgagtggtaccggctggtgaccacgatgttcacccacgaggagatctggcacatcggcttcaacatgatcagcctctggttcctcggcggccccctggaagcggccctcggcagagcccgctacctcgccctctacctcgtctccggcctcgccggcagcgtgctcgcctacctgctggcctcgcccaccacggccaccctcggcgcctccggcgcgatcttcggcctcttcggcgccaccgccgccctcgtgcgccggctcaacgccgacatgcggccggtcgtcatcctgctggtgatcagcctgatcttcaccttcacccggggcaacatctcctggcaggcccacgtcggcggcctcgtcgcgggtgccgtgatcggctacgccatgcttcacgcgccccgtgagcggcgcacgctcgtccagtacggcacctgtgcgctggtcctcctggtcgtcgtcggcctgaccctgctgagatcggcgcagctcacctga

SEQ ID NO: 964 - protein, 297 aa, Streptomyces coelicolor
MDHAAAGRPDAQSLPGCYRHPDRETGIRCTRCERPICPDCMVNASVGFHCPDCAAGRTPGATGPAPGASRPRTLAGGTVAADPHLVTKILIGINVAVFIAVQALPSSFLSDMVLIGRWPPAPFVPTEGVAEGEWYRLVTTMFTHEEIWHIGFNMISLWFLGGPLEAALGRARYLALYLVSGLAGSVLAYLLASPTTATLGASGAIFGLFGATAALVRRLNADMRPVVILLVISLIFTFTRGNISWQAHVGGLVAGAVIGYAMLHAPRERRTLVQYGTCALVLLVVVGLTLLRSAQLT

SEQ ID NO: 965 - DNA, 897 bp, Schizosaccharomyces pombe
  CDS (1)..(897)
atgaatcgtttgaattttcaaagtttactctggaaatttggacaaaaaaggttttattacagaccatggatcagaattgaaaatattaaaccaacaccattatggaaaccgattacatttgctgttggtgttggttctgccaccttttatacggccaattatctcgataaaagaagaaaaaactaccccaaaagctcatacggatttccaattccccaaacatctagtcgaagtttggtattgtcgataattggaatcaacgtcggtgtgtttgcgttatggcgagctccgaggtttagtcatttaaatagatttttacaaaaatatgctgtcatgaaccctatatttattaatatgccatcgatgatcgtatccgcattcagccatcaatctggatggcatttgctattcaacatggttgccttttactcctttgcgcctgcaattgttgacgtttttggaaataatcagtttgttgcattttatatttcttcgattcttttttctaacgttgcttctctcttgcaccatcgtttgcgctttgggactaaagttactccaggatcattaggtgctagtggtgcaatctatgctattgctgctgctacatcttatttcttcccaaatgcttctgtctccattattttccttccctttatacctattaaaattggagttgcgctattaggcctcatggcctttgatgcttggggattaatttctcgagggttttcctcctttgcaaactttacactcattgaccacgctgcacatcttggaggtggaatattcggttggttgtatgctaaatatggctattctacgtacaaccgatcgactcgtccccgtccaccgtcgttgagtaaaccatttttttcaagatccgtttccttttga

SEQ ID NO: 966 - protein, 298 aa, Schizosaccharomyces pombe
MNRLNFQSLLWKFGQKRFYYRPWIRIENIKPTPLWKPITFAVGVGSATFYTANYLDKRRKNYPKSSYGFPIPQTSSRSLVLSIIGINVGVFALWRAPRFSHLNRFLQKYAVMNPIFINMPSMIVSAFSHQSGWHLLFNMVAFYSFAPAIVDVFGNNQFVAFYISSILFSNVASLLHHRLRFGTKVTPGSLGASGAIYAIAAATSYFFPNASVSIIFLPFIPIKIGVALLGLMAFDAWGLISRGFSSFANFTLIDHAAHLGGGIFGWLYAKYGYSTYNRSTRPRPPSLSKPFFSRSVSF

SEQ ID NO: 967 - DNA, 1038 bp, Homo sapiens (Human)
  CDS (1)..(1038)
atggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaa

SEQ ID NO: 968 - protein, 345 aa, Homo sapiens (Human)
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 969 - DNA, 1764 bp, Neurospora crassa
  CDS (1)..(1764)
atgaactgctccctgggcgtcaatgcctttcggccgggcgtccaggttgccgctcaccacttttccaaagcatgtagccgactgctcgtcgccgccgcacccacgacgcgatgcttctcttccacgacattgctcccatccacggcccagaaccaatggcaagccaagcggggccgcctttcttcctcgacacctttttctggaccctcttcgatctcgcgcatcgccgtacgcaccctcaagtttgccgcccgcaacagggtcattatccactatgtagacctacccccgaactacaaagacgaggagggcttgccattccgcgtcgatgacctggcagctggcgaggttcttcaactattcgggccccagatgaccacccctgcggctaatcggttgctaaaaattcttcacggtcgacgcgtcgctggaacccttgacgaccctgtgctcaaagtcaatactgccggatacactcctaaagataggagaatcgccttggactaccttcgcaaaaatgtctatgtcgacgaggtcgtgaacgccggcctacgcgccgaggacgagctggcagccctggaaaaacaacaagaagaagacgcccaggcccaggcccaggccgagggagaggacaacgtcaccaagcaactggggtacaagtcacggttcaagatgtaccaggacgattctgagggtctcgacgaatccgagcaaaagaaacccgaaccccgatcggtttacggcaaaagcgctttcgatgctattcgcgcgcggaacgaggctatctggaaggagaagctcaggaagcaggaagaggaacgtaagaagctcgaggaagagtacaagaacggcaaggccgggcctctcgctaaagcggacgacaccccgaagcgtgaagttagcgccaagagaaaggaatgggaggaatgggccatgtctgacctcaaggaacctcccaagatgcctgcgtggaagcgtctgctgccctcgaccgtctttgtaactctcctcgttgccggctttctcacctactctcaactctacgtcgcccccagccgcgacaacaggttatggcccgattgtcctccagcagccgccaccgttgccgtcctcatcggcgccaacgttctgatctggttcctctggaaggtccctgtcatgtggaagcctttgctgcggtacttcttgatttcgcctgcgacacctaacgcgttcagcatgcttggtgccgtgttctctcaccaggttgtctggggtcatcttattgtcaacatgcccttcctctggttctttggcacccggcttcacgacgaggttggcagggccgacttcctgactacttatatcctgtccggatctgttggcttcctgaccagtctgttctggctcgtgctaaagggtaacttccatatgactaccctcggcgcatctggcgccatctacggcatctccgcagcctacttttggatgcacagattcgagggcttcaagatctttggcctgcctcctgacccgtataccggcgtccagggattggcctttattggactgttcggaggtctgaacatatggggattgttcagcaggaaccataccatggatgtcgtatcccatctgggtggcatgcttgttggtattattgccggtcatctgatggagcaaaagaagaaggcgaggcttcaaggagcgggaaacacccagctgaacttgaaggaccagaagactgggtccggcgttctggacaccatgctggagaagaactaa

SEQ ID NO: 970 - protein, 587 aa, Neurospora crassa
MNCSLGVNAFRPGVQVAAHHFSKACSRLLVAAAPTTRCFSSTTLLPSTAQNQWQAKRGRLSSSTPFSGPSSISRIAVRTLKFAARNRVIIHYVDLPPNYKDEEGLPFRVDDLAAGEVLQLFGPQMTTPAANRLLKILHGRRVAGTLDDPVLKVNTAGYTPKDRRIALDYLRKNVYVDEVVNAGLRAEDELAALEKQQEEDAQAQAQAEGEDNVTKQLGYKSRFKMYQDDSEGLDESEQKKPEPRSVYGKSAFDAIRARNEAIWKEKLRKQEEERKKLEEEYKNGKAGPLAKADDTPKREVSAKRKEWEEWAMSDLKEPPKMPAWKRLLPSTVFVTLLVAGFLTYSQLYVAPSRDNRLWPDCPPAAATVAVLIGANVLIWFLWKVPVMWKPLLRYFLISPATPNAFSMLGAVFSHQVVWGHLIVNMPFLWFFGTRLHDEVGRADFLTTYILSGSVGFLTSLFWLVLKGNFHMTTLGASGAIYGISAAYFWMHRFEGFKIFGLPPDPYTGVQGLAFIGLFGGLNIWGLFSRNHTMDVVSHLGGMLVGIIAGHLMEQKKKARLQGAGNTQLNLKDQKTGSGVLDTMLEKN

SEQ ID NO: 971 - DNA, 924 bp, Rhodopirellula baltica
  CDS (1)..(924)
atgattgccagaatggggctgaacgaacgcgactacagtcgctccgaacgaacaccgtgggatcgaattgagaatcccttgtcgatgatcaaggttttgatcgggatcaatgtcgcgttattcgcggtagattggctgtcgaaagggctgctcagcgattggtttggcgtcagcggccaaacgttgcttcaaccttggttgtggttccaaccactgacctacgggttcatgcacaataccgaggaggtcctgccactacacattctcttcaacatgttcttgttgttcgtctttgggagtccggtagaacaacggttgggggggcaggagtttctcaggttttatttgatcgcggtgatcgcgggtggcatcgttgggatgctgtacccatgtgccatctcgttgttccagactgggcaattgagtcccgagatcattggcgtgtcgacgatcggggccagcggtgcggtgatcgcggtaatggtcctcttcgcttgctacttcccccaccaggaagtgctcttcatgttcgtttttcccgtgaaagcgtgggtgttggcctcggttttggtactgattgatttggtgtccgctttggggcttttcggttccgccagctcgaccgcctttgaagttcacctggcgggggcactctttgggttcctgtatcaccgacttcagtggtcattccattggcttgatttcagacggtttggcgatttcaaggacgaaatgaggctgaaatctcgtcgagcaaagctgaaattgcatgatcccgacaaaaaaatccgcgccgaagcagaggatgcggaccgaattctggctaaaatccatgagtcaggggaatccagcctgacttcctcggaacgtaaaaccttggagagatacagccggcgtcagcgacaaaaacgcgaactggactga

SEQ ID NO: 972 - protein, 307 aa, Rhodopirellula baltica
MIARMGLNERDYSRSERTPWDRIENPLSMIKVLIGINVALFAVDWLSKGLLSDWFGVSGQTLLQPWLWFQPLTYGFMHNTEEVLPLHILFNMFLLFVFGSPVEQRLGGQEFLRFYLIAVIAGGIVGMLYPCAISLFQTGQLSPEIIGVSTIGASGAVIAVMVLFACYFPHQEVLFMFVFPVKAWVLASVLVLIDLVSALGLFGSASSTAFEVHLAGALFGFLYHRLQWSFHWLDFRRFGDFKDEMRLKSRRAKLKLHDPDKKIRAEAEDADRILAKIHESGESSLTSSERKTLERYSRRQRQKRELD

SEQ ID NO: 973 - DNA, 744 bp, Streptomyces avermitilis
  CDS (1)..(744)
atgctctgttccgtgatcagcaggtggagtacgacggtcggcagcgcggtccgggcacagtcggcgccggtgacgtacggactgatcggcctctgctgcctgatcttcgcgatcggccccgcggcgggactcaatcccgcccacggcaccggggaggggctgctcgccgcgcagcagacctacttcgcccgctggggcgtggtgcccgcggagctcttcagcggagccccgcgcgcggcactcaccccggccacggcgctcttcgtgcacggcagctggatccatctgctgggcaacatgctcttcctctacgtcttcggggcgatggccgaggaacgcctgggacacctcgagttcgccctgttctatctgggctgcggctatctcgccctgctcgggtacgcggcggccaacgccggctcgacgcagacgctggtcggcgcgtccggatcgatctccgcggtcctcggcgcgttcctctacctgttccccggggcccgggtgaccagtctcttcccgttcctcttcttcctgccgctgcgccttccggcctgggtcgtcctgcccttctgggccgccctccagtggctggccgcgagccgcgtcgccaccggcccgagcgtcgcctacctggcccacctggtgggcttctcgctcggcttcctctacgcgtgggtgcgctacggacggacgactagagtgaaaaccccagcagcggcccccgagggagaaaaccagccgtga

SEQ ID NO: 974 - protein, 247 aa, Streptomyces avermitilis
MLCSVISRWSTTVGSAVRAQSAPVTYGLIGLCCLIFAIGPAAGLNPAHGTGEGLLAAQQTYFARWGVVPAELFSGAPRAALTPATALFVHGSWIHLLGNMLFLYVFGAMAEERLGHLEFALFYLGCGYLALLGYAAANAGSTQTLVGASGSISAVLGAFLYLFPGARVTSLFPFLFFLPLRLPAWVVLPFWAALQWLAASRVATGPSVAYLAHLVGFSLGFLYAWVRYGRTTRVKTPAAAPEGENQP

SEQ ID NO: 975 - DNA, 897 bp, Streptomyces avermitilis
  CDS (1)..(897)
atggacgaccccatgaaccagaaaccacagaacgcccagggcgtgcccacctgctaccggcacccggaccgcgaggccggcgtccgctgcacccgctgcgagcgccccatctgccccgagtgcatggtcgacgcctcggtcggtttccagtgccccgagtgcgtccgtgggggctccggcaccggtcacgctccgacggccacccagccccgtacgatcgcgggcggcaccgtggccgcggacccgaggctgatcaccaagatcctcatcggcctcaacctcgcggtcttcctggtccagctgtccgtgggtgatcgcttcaccgagcgcttcgaactcctcggccgcgcctacgtgccacttctcggttcgttgcaaggtgtcgccgaggggcagtcgtaccggctactgaccgcgatgttcctgcacgacccccacagctatgtccacatcctgttcaacatgctcagtctgtggtggatcggcggccccctggaagcggccctcggccgtatccgctatctcaccctctacttcgtctccggtcttgcgggcagcgggctcacctatctgatcgccgccccgaaccagccctcgctcggcgcctccggcgccatcttcgggctcttcggcgccaccgccgtcctcatgcgcaggctcaactacgacatgcgcccggtcatcgcgctgctggtgatcaacctgatcttcaccttcgggtggagcaacatcgcctggcaggcgcacatcggcgggctcgtcggcggagtggtggtcggctatgcgatggtccacgcaccgcgtgaccggcggaccctcatccagttcggggtcagcggcctggtcctggccgccgtggtcctcatgacggtcctcagaaccatccagctcacctga

SEQ ID NO: 976 - protein, 298 aa, Streptomyces avermitilis
MDDPMNQKPQNAQGVPTCYRHPDREAGVRCTRCERPICPECMVDASVGFQCPECVRGGSGTGHAPTATQPRTIAGGTVAADPRLITKILIGLNLAVFLVQLSVGDRFTERFELLGRAYVPLLGSLQGVAEGQSYRLLTAMFLHDPHSYVHILFNMLSLWWIGGPLEAALGRIRYLTLYFVSGLAGSGLTYLIAAPNQPSLGASGAIFGLFGATAVLMRRLNYDMRPVIALLVINLIFTFGWSNIAWQAHIGGLVGGVVVGYAMVHAPRDRRTLIQFGVSGLVLAAVVLMTVLRTIQLT

SEQ ID NO: 977 - DNA, 855 bp, Leptospira interrogans
  CDS (1)..(855)
atgtctttgaattccgaggagaaatcatgttcctctatgacaggaatctacaatcgaatcggcccggagctgactccagtagtccgtaccttattgattttaaacgggagtatctttgcggttcaacttctactttcctggacggtaggagattacctaactctttattttggaatgacttccgatatgatcactcaccgtttttttatttggcaatttctgacatacgcattcctacactccgttcaaaatttctttcacatcttattcaatatgttttctctttggatgtttggttcggttttagaaagttactggggtagtagaaattttttgaagttttatttattctcttgttttatggggggtttttttccttggattttgcataacgttggatttcatcaaggtacaatcattggcgcttccggtggaatctacggtcttttgatcgctttcgctttgatttggcctaaccaagaacttctttttatgggcttttttcctcttaaagcaaagtatatggttgtaattcttatgctcatcattgcgttttcaggttctggtagcaacatcgcacacatggctcatttgggtggagcaataggtggagcgatttatttcttttattataataaactaaagtctaaaattcctgcttctttgtctctcagtcgttaccttcagaaaagaaagatgaaaaaatggcaagaagaaatgaatcgtaaaattcatgtcagagaagaagtagatcagttattggataaaatttctaaatccggtatgaattctctttctagaaaagaaaaaaaatttttgaaagaagcttcgagtaagtattactcagaagattga

SEQ ID NO: 978 - protein, 284 aa, Leptospira interrogans
MSLNSEEKSCSSMTGIYNRIGPELTPVVRTLLILNGSIFAVQLLLSWTVGDYLTLYFGMTSDMITHRFFIWQFLTYAFLHSVQNFFHILFNMFSLWMFGSVLESYWGSRNFLKFYLFSCFMGGFFPWILHNVGFHQGTIIGASGGIYGLLIAFALIWPNQELLFMGFFPLKAKYMVVILMLIIAFSGSGSNIAHMAHLGGAIGGAIYFFYYNKLKSKIPASLSLSRYLQKRKMKKWQEEMNRKIHVREEVDQLLDKISKSGMNSLSRKEKKFLKEASSKYYSED

SEQ ID NO: 979 - DNA, 828 bp, Chlorobium tepidum
  CDS (1)..(828)
atgacccgatacgaccagccatactcgcccggcggcttccaggtgatgccgccggccatcaaggcgatcatcatcaccaatgtgattgtgttcctcttccagaacagcgctttcggccctgccctcaccacgtttggcgcactctggccaataggctcgcacaacccggcgggctactcgtttcacctctggcaacccattacctatctctttctgcatggcagtttcgcgcacatctttttcaacatgttcgcgctctggatgttcggcgttgaaatcgaaaactactggggaaccagaaacttcgtcagtttctattttatctgtggcattggcgccgcgctcatcaatcttctggcgacctacggcagcccctacccgaccattggcgcctctggagccattttcggtgtgctgctcgcgttcggtatgatgttccccgaccgatacatctatctctacttccttctgccgatcaagaccaagtacttcgtggccggatacgccctgatcgagttcatcatgggtctcggcaaccggacgatgggcagcggcagcgacatcgcctatttcgcccatcttggcggtatgcttttcggctatatctacatcgtgatccggcggaatgaatggacgatcaagcggatgtttcgggacttctctctgccaaaaaaaccgaaagggccggttctctggcaaggcggcggcaaggatgacgatacctccgaagccgagatcgaccggattctcgacaagatttcgagcaggggttacgactccctgacggcggaggaaaaacgcacattgctcaaggcaggtaaacgctga

SEQ ID NO: 980 - protein, 275 aa, Chlorobium tepidum
MTRYDQPYSPGGFQVMPPAIKAIIITNVIVFLFQNSAFGPALTTFGALWPIGSHNPAGYSFHLWQPITYLFLHGSFAHIFFNMFALWMFGVEIENYWGTRNFVSFYFICGIGAALINLLATYGSPYPTIGASGAIFGVLLAFGMMFPDRYIYLYFLLPIKTKYFVAGYALIEFIMGLGNRTMGSGSDIAYFAHLGGMLFGYIYIVIRRNEWTIKRMFRDFSLPKKPKGPVLWQGGGKDDDTSEAEIDRILDKISSRGYDSLTAEEKRTLLKAGKR

SEQ ID NO: 981 - DNA, 693 bp, Pyrobaculum aerophilum
  CDS (1)..(693)
atggctctgccgttgcgagatataaatcctacaatgacgtttccgtttgtcacaaaggcgttggtgtttataaacgttgccgtgtttatctacgagcttcttaaccccgccgttattcaaaaatacgcctttgttccagccctggcattttcagagccttacagatgggttacgcacatgttcctccacgggggacttctgcacatagttggtaatatgatctacctgtgggtcttcggcgacaatgtggaggatcactacggacacttccgttttctagcgctttatctcatgtgggggttggccgccgcctttgttcactactgggctgtggctagccaagcggcattgctatccgcagtgggcgttgtgggagatcccatgtgggtgcctgccgtaggcgcctcgggggctataagcggggtgctcggcgcctatatggtgctctatccacacgcgcggattttaacccttacttttttcatagtgataacgctggtggaaatacctgcttgggcttacataggattttggtttatttaccagctcttttacggcgcattggagttcatcacgttgcagtcaagcggcgtggcgtacttcgcccacataggagggttcattgcgggggctctgaccgcgttaatatatagaaggaggcgtgctgtgcattactactggtattggcagtaa

SEQ ID NO: 982 - protein, 230 aa, Pyrobaculum aerophilum
MALPLRDINPTMTFPFVTKALVFINVAVFIYELLNPAVIQKYAFVPALAFSEPYRWVTHMFLHGGLLHIVGNMIYLWVFGDNVEDHYGHFRFLALYLMWGLAAAFVHYWAVASQAALLSAVGVVGDPMWVPAVGASGAISGVLGAYMVLYPHARILTLTFFIVITLVEIPAWAYIGFWFIYQLFYGALEFITLQSSGVAYFAHIGGFIAGALTALIYRRRRAVHYYWYWQ

SEQ ID NO: 983 - DNA, 1140 bp, Homo sapiens (Human)
  CDS (1)..(1140)
atggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaa

SEQ ID NO: 984 - protein, 379 aa, Homo sapiens (Human)
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 985 - DNA, 1140 bp, Homo sapiens (Human)
  CDS (1)..(1140)
atggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacctgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaa

SEQ ID NO: 986 - protein, 379 aa, Homo sapiens (Human)
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYLGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 987 - DNA, 1056 bp, Drosophila melanogaster (Fruit fly)
  CDS (1)..(1056)
atgctcatgagtcgagcgctttgccggagctggctaccccaggtggcccgcagatgtcatgctaatgtgaatgtgccaatcctgcggataaactctggtcatccggcggcgaggtcatgtcggcagattcacagcaaccgaaaacagagcagcaacctgaagccgacgactggggagcctgcggcagcggagcagaacaccccggtgccggtgaacaatgtgatcaaggcggtggccttcacgggagcatttacggtcggctgctttgcgggtgccaccatcctggagtacgagaacacacgtagcctaatcctagaaaaggctcgccaggcgagattcggttggtggcagagtcgttcgctggcggacagggattactggacacagatcaaacaagacatccggcggcactgggactcactgacacccggcgacaagatgtttgctcctatcttactctgcaatttggtggccttcgccatgtggcgggtgcccgctctgaaatccacaatgattacctacttcacatccaatccagcggcgaaagtcgtctgctggcccatgttcctgtccacattcagccattactcggctatgcaccttttcgccaatatgtacgtgatgcacagctttgccaacgctgcggctgtatcgttgggtaaagagcaattcttagcggtctacctcagcgccggcgtcttctccagtctgatgagcgtgctctacaaggcggccacgagtcaggcggggatgtccctgggtgcgtctggagctataatgacactgctggcctatgtatgcacccagtatccggacacacaacttagcattctctttctacccgcgttgacattctccgctggagctggtattaaagtgctaatgggcatcgactttgctggcgtcgtgatgggctggaagttcttcgatcacgcagcgcatttgggcggcgccatgtttggcatcttttgggccacgtatggggcacagatatgggcaaagcgcattggtctactgaattactaccatgacctgcgccggacgaagcagaaatag

SEQ ID NO: 988 - protein, 351 aa, Drosophila melanogaster (Fruit fly)
MLMSRALCRSWLPQVARRCHANVNVPILRINSGHPAARSCRQIHSNRKQSSNLKPTTGEPAAAEQNTPVPVNNVIKAVAFTGAFTVGCFAGATILEYENTRSLILEKARQARFGWWQSRSLADRDYWTQIKQDIRRHWDSLTPGDKMFAPILLCNLVAFAMWRVPALKSTMITYFTSNPAAKVVCWPMFLSTFSHYSAMHLFANMYVMHSFANAAAVSLGKEQFLAVYLSAGVFSSLMSVLYKAATSQAGMSLGASGAIMTLLAYVCTQYPDTQLSILFLPALTFSAGAGIKVLMGIDFAGVVMGWKFFDHAAHLGGAMFGIFWATYGAQIWAKRIGLLNYYHDLRRTKQK

SEQ ID NO: 989 - DNA, 726 bp, Geobacter sulfurreducens
  CDS (1)..(726)
atgatcccgctcaaggactacaacccgacgcgacgcttgccggtggtgagcgtcgcgctcatcattctcaattgtgccgcgttcctgttcgaccgttacaccggccactacgagccgctgatcgttgagacggcccgggggctggtccgaacgcggcagttcgtcggaggactgtcggcggactactcgctggttcccgccgtgcttacttcccatcccctccttgccttgcccaccatcatcacctcaatgttcctccacggcaactggctccacatcggctcaaacatgctctacctctggatattcggcaacaatgtggaggatgtgctggggcggttccgcttcgtggtgttctatctgggctgcggcgccgtggcggccctggcccaggtggcaagcgcgcccggttccgatatcccgatggtgggggccagcggcgccgttgccggcgtgatgggggcctatctgctcctgttcccccatgcgcggatactgacgctggtgccgatcatcttcttttttaccttcatcgaagtaccggcattcatcatcatcggctggtgggtgctcatccagttcctgaacgccaactggctcggcgggggggaattgcgtggcggcgtggcctatttcgcacacatcggcgggtttgtggccgggattgtaggtctctggcttttcggggcggcgcgccgggggggcaggccctaccggcgctggtag

SEQ ID NO: 990 - protein, 241 aa, Geobacter sulfurreducens
MIPLKDYNPTRRLPVVSVALIILNCAAFLFDRYTGHYEPLIVETARGLVRTRQFVGGLSADYSLVPAVLTSHPLLALPTIITSMFLHGNWLHIGSNMLYLWIFGNNVEDVLGRFRFVVFYLGCGAVAALAQVASAPGSDIPMVGASGAVAGVMGAYLLLFPHARILTLVPIIFFFTFIEVPAFIIIGWWVLIQFLNANWLGGGELRGGVAYFAHIGGFVAGIVGLWLFGAARRGGRPYRRW

SEQ ID NO: 991 - DNA, 24 bp, Primer
atgtcaggtgtaagctctgttatg

SEQ ID NO: 992 - DNA, 23 bp, Primer
ttaaaaccacctaccagcagcct

SEQ ID NO: 993 - DNA, 642 bp, Saccharomyces cerevisiae
  CDS (1)..(642)
atgtcactaccggcacatttgcagcagactttctcaccagaagaaatacagttcattgtggaaaacgagccaataaagatttttcccagaataacaacacgccaaaaaattcgtggcgatgatagaggaactggaaaccacacccgctggcaacttattactacagatgacaaagctttaaataatatggtagccatgcgttctacagaagtggttctttggatcgctctattactgaagcaacaatccaagtgcagtattgtagcaccacagtggttaacgacgaaagagcttgatagaaaaatacaatatgagaaaactcatccggataggtttagtgagttgccgtggaactggcttgtcttggcacgtatacttttcaataaagctaaggatgattttcatgaccccattcacgaattacgtggtaaaatacaagacttaagggaaataaggcagatcaaagtgttaaaaggccttaagtatttgaatgaatctcatttacaattggataatttaagtctattagaaatcaatgagttgaggccgttcattactgaaatcatggataaactgcgagaaattcacacagcatctcttaccgctggtactgaaaatgatgaagaagaattcaatatttaa

SEQ ID NO: 994 - protein, 213 aa, Saccharomyces cerevisiae
MSLPAHLQQTFSPEEIQFIVENEPIKIFPRITTRQKIRGDDRGTGNHTRWQLITTDDKALNNMVAMRSTEVVLWIALLLKQQSKCSIVAPQWLTTKELDRKIQYEKTHPDRFSELPWNWLVLARILFNKAKDDFHDPIHELRGKIQDLREIRQIKVLKGLKYLNESHLQLDNLSLLEINELRPFITEIMDKLREIHTASLTAGTENDEEEFNI

SEQ ID NO: 995 - DNA, 543 bp, Caenorhabditis elegans
  CDS (1)..(543)
atgaatgcagaacgttgcgagttcatcgccggaaactcgcttattgaagtgatcccctcaatttccgatgaccggccgattcacctgatttccggcgatattggtccatttgaggcaggcgtaccctgtcggattccagtttggacagcgattttgatgaaacgaaaacacaattgcaaggtggtggctcctcaatggatggatgtagatgagctgaagaagatattgacgtcagagactgaaagccaaggattggcgaaattaccggatcatttctttgaaatctcgcatatgcttgttcgagatgcccgtgaggatatattcgaagttgaagctgtcaaatcattggttcaggacatttatgatcggagggacgcaaaacttcgaagctcagcgatcgaattcttgagacagaaccaaacctgccacgctcaattggacaacgttcagctgattgaagcatcgtccgctcgtgccactttggaggcctgtcgtcagatgggagctgtcgtccgtaataaacacgaatcaacacctttatag

SEQ ID NO: 996 - protein, 180 aa, Caenorhabditis elegans
MNAERCEFIAGNSLIEVIPSISDDRPIHLISGDIGPFEAGVPCRIPVWTAILMKRKHNCKVVAPQWMDVDELKKILTSETESQGLAKLPDHFFEISHMLVRDAREDIFEVEAVKSLVQDIYDRRDAKLRSSAIEFLRQNQTCHAQLDNVQLIEASSARATLEACRQMGAVVRNKHESTPL

SEQ ID NO: 997 - DNA, 552 bp, Schizosaccharomyces pombe
  CDS (1)..(552)
atggccttaccaagggaacttgaaatttcattctcaccagaggaaatggaatttttagctggcaatgagtatattaacattgttccttcagaaacaatggatcaattgccgctagttagcgcgacgattcccattatgaagcctcccaaaaaatgtcgggttcctttatggttggctcttgagctaaaaaagcaaaatttggcaaggattgtacctccggaatggatggaaataggcaaacttgaaaacatacgagatgatgaattggaaaacgagacattctcagagttgccttttcggtggctagaaacggcgcatttattgttaaacttctgtgctgatgatatcgaggatgttgaggatatcaggaggattttgctggacattcgagaagctagacaaagtaaagcaagaacgggattggaagccattaatgaagttcaactaactttggataatttgggtgcaatggaaattaacgaaatacgtcctatatttcgagaggtgatggacagaatgcgcaaaattgttcaagtttcccaagaagaatga

SEQ ID NO: 998 - protein, 183 aa, Schizosaccharomyces pombe
MALPRELEISFSPEEMEFLAGNEYINIVPSETMDQLPLVSATIPIMKPPKKCRVPLWLALELKKQNLARIVPPEWMEIGKLENIRDDELENETFSELPFRWLETAHLLLNFCADDIEDVEDIRRILLDIREARQSKARTGLEAINEVQLTLDNLGAMEINEIRPIFREVMDRMRKIVQVSQEE

SEQ ID NO: 999 - DNA, 822 bp, Neurospora crassa
  CDS (1)..(822)
atggcgctcccactgccaccagggctgacccagaacgaggtcgccttccttgccgagatggaaatggtcaccgtcgtcccacgtcagcgcctggacagcatcgacctgctcggtggaaaaacaccacaacttcggcctccccaccgcgcccagctgcccctctggctcgccctcctcctcaagaaacagcgccgcgccaacatcgtccctccagcatggatgcatcccgcctcccttgccgagattatccatcgcgaaacaaaagaagatcccgaagctttctccccgccaccacctcctccctcgcgcgctctgtactcccagcctggcaccgcacgccggctaaaccccagttatctcgatgactttacgcaaacgcaacaagactcgcaacaagatccgaactccatcttatctcctcccttcctcccttccaacgtcgccgaatcccccgccggatacctcccctaccactggctcgaggttgccgaggctttgctcacacacgccggcgatgacatgcccgccccggctggcgaggtgcggtcgctactgcgagacttggtggaggtgcgcgcagccaagatgcgcagcagtacatcggctttggaggggtttggtgatgcctatttgaccctgcgtggcgttggtgctatggagttagctgagaacagagcttttctggcgggcttggtggatggcgtacggaagattggggccagcgccgaggcgacgagaagggaagaggaagaggaggctaggaggggcggggactatggtggtgatggggatgaggatagtgatgaggatatgggcctttga

SEQ ID NO: 1000 - protein, 273 aa, Neurospora crassa
MALPLPPGLTQNEVAFLAEMEMVTVVPRQRLDSIDLLGGKTPQLRPPHRAQLPLWLALLLKKQRRANIVPPAWMHPASLAEIIHRETKEDPEAFSPPPPPPSRALYSQPGTARRLNPSYLDDFTQTQQDSQQDPNSILSPPFLPSNVAESPAGYLPYHWLEVAEALLTHAGDDMPAPAGEVRSLLRDLVEVRAAKMRSSTSALEGFGDAYLTLRGVGAMELAENRAFLAGLVDGVRKIGASAEATRREEEEEARRGGDYGGDGDEDSDEDMGL

SEQ ID NO: 1001 - DNA, 636 bp, Oryza sativa (Rice)
  CDS (1)..(636)
atggctgggcagtctgaccctcatctttctatcttctcaccctcagaggtggagttcgtggcggaggatgagattgtcgagatcgtccctaacattcgcatggaggccctcaacatgatatgcggggattttgggcccttcttcccgcaaattgcaagcaaagtgcctctttggctcgcggttgcactcaagaagcgtggcaaatgtaccatacgcacacctgactggatgactgttgaccgcttgacgcaggtattagatgcagaaagagagtcacccaaagaatttcagccattgccgttccactatattgaaatatctaagcttctctttgatcatgctcgtgatgacatctcagatgcatacctggtaagatctttgattgaggacatccgagatgtcagattccataaggttgagactggtctggagacaatatctggccgtactcatgctgtaaagctaaaaaatctctctgcaatggaagtgaatatcgtgcgtcctttcatggtgagaactttacaagcattctataagcatgatagcccacagatgattcagcaggcagataacacaggtagcagaccaacaccagttacagaccgtggtccaagaagagatctaaggcgcaggtaa

SEQ ID NO: 1002 - protein, 211 aa, Oryza sativa (Rice)
MAGQSDPHLSIFSPSEVEFVAEDEIVEIVPNIRMEALNMICGDFGPFFPQIASKVPLWLAVALKKRGKCTIRTPDWMTVDRLTQVLDAERESPKEFQPLPFHYIEISKLLFDHARDDISDAYLVRSLIEDIRDVRFHKVETGLETISGRTHAVKLKNLSAMEVNIVRPFMVRTLQAFYKHDSPQMIQQADNTGSRPTPVTDRGPRRDLRRR

SEQ ID NO: 1003 - DNA, 831 bp, Oryza sativa (Rice)
  CDS (1)..(831)
atggctgggcagtctgaccctcatctttctatcttctcaccctcagaggtggagttcgtggcggaggatgagattgtcgagatcgtccctaacattcgcatggaggccctcaacatgatatgcggggattttgggcccttcttcccgcaaattgcaagcaaagtgcctctttggctcgcggttgcactcaagaagcgtggcaaatgtaccatacgcacacctgactggatgactgttgaccgcttgacgcaggtattagatgcagaaagagagtcacccaaagaatttcagccattgccgttccactatattgaaatatctaagcttctctttgatcatgctcgtgatgacatctcagatgcatacctggtaagatctttgattgaggacatccgagatgtcagattccataaggttgagactggtctggagacaatatctggccgtactcatgctgtaaagctaaaaaatctctctgcaatggaagtgaatatcgtgcgtcctttcatggtgagaactttacaagcattctataagcatgatagcccacagatgattcagcaggcagataacacaggtagcagaccaacaccagttacagaccgtggtccaagaagagatctaaggcgcagctgcaggccagcagccgtcactcgatatcatattcatgaaaaatttatgcgcattttactgtgtttttgtcaatcgatcgagagagatgtttcgtccggtgaggcagtggcgactgcaccagctgccggccaagcacatatatgcatcgtgaaatttccgagaaagaaaacaacacgggagaaaggtaacaagaagtag

SEQ ID NO: 1004 - protein, 276 aa, Oryza sativa (Rice)
MAGQSDPHLSIFSPSEVEFVAEDEIVEIVPNIRMEALNMICGDFGPFFPQIASKVPLWLAVALKKRGKCTIRTPDWMTVDRLTQVLDAERESPKEFQPLPFHYIEISKLLFDHARDDISDAYLVRSLIEDIRDVRFHKVETGLETISGRTHAVKLKNLSAMEVNIVRPFMVRTLQAFYKHDSPQMIQQADNTGSRPTPVTDRGPRRDLRRSCRPAAVTRYHIHEKFMRILLCFCQSIERDVSSGEAVATAPAAGQAHICIVKFPRKKTTREKGNKK

SEQ ID NO: 1005 - DNA, 633 bp, Arabidopsis thaliana (Mouse-ear cress)
  CDS (1)..(633)
atggctggccagactgatcctcatatttcactgttttctccacaagaggttgagtttatggcagaggacgagctggtcgagattgttcctaatatgaacatggagcaactcaatttcatcagtggcgatttcggtcggttcattcctcagattccgacaaaggtgcctctgtggcttgcagtggcactgaagaggagaggaaaatgcactttccggcctccggggtggatgtctgttgataatttgactcagatcttggaagcagaacgtgaatctcagtcgacattccaggcattaccatttagttacgtggagattgccagactactttttgaccatgcacgtgacgatattccagacatgtatatggtgagatccctagtcgaggacatcagagatgtacggcttcacaaacttgagactaacttaggatcatttcaaggtacatctgcagtaaagatctctaatgtatcggcaatggaagtaaacatagtacgcccatttgtgataagagccttagaagcattttataagcatgacaagccagaggctgatgtagacagagacaccagaagtagtagacaacagcgtgaaaccaacaatgaaccaaggagacctctaaggcaacgctag

SEQ ID NO: 1006 - protein, 210 aa, Arabidopsis thaliana (Mouse-ear cress)
MAGQTDPHISLFSPQEVEFMAEDELVEIVPNMNMEQLNFISGDFGRFIPQIPTKVPLWLAVALKRRGKCTFRPPGWMSVDNLTQILEAERESQSTFQALPFSYVEIARLLFDHARDDIPDMYMVRSLVEDIRDVRLHKLETNLGSFQGTSAVKISNVSAMEVNIVRPFVIRALEAFYKHDKPEADVDRDTRSSRQQRETNNEPRRPLRQR

SEQ ID NO: 1007 - DNA, 573 bp, Brugia malayi (Filarial nematode worm)
  CDS (1)..(573)
atgacgccggaacaatgtgaatttattgccggtaatgaatggattcagataaatccgcagtttaatttggatgaattgcatctgatatgtggtgatattggaccatttgaagctggtatgcctatttgggtaccactctggatagcagttacgttaaggaaaaggcgaaaatgcactatcattccaccacaatggttatgtgtggaggagttgaaaaagcttgtaatagcggaaagtggaactaatgcatttggacaagtaccacggttttatttggaaatagctcacatgttcgtacaatatgccaaagaagatcttccggatagcgatatgatacgagtttatgtacaagatttatgggataagcgatctgcaaagctcaacaattcatcgactaaatttttgggacaggtagaatcatgtcatgcaagaatggacaatattactttgatggaagtagcgtatattaaacgatcactaattacagccagtcgtgaaattgaagcgcttaacaagtcgtttcatgaattatccagtcaaaacagcagtgatcaaagatatgtaatagcttga

SEQ ID NO: 1008 - protein, 190 aa, Brugia malayi (Filarial nematode worm)
MTPEQCEFIAGNEWIQINPQFNLDELHLICGDIGPFEAGMPIWVPLWIAVTLRKRRKCTIIPPQWLCVEELKKLVIAESGTNAFGQVPRFYLEIAHMFVQYAKEDLPDSDMIRVYVQDLWDKRSAKLNNSSTKFLGQVESCHARMDNITLMEVAYIKRSLITASREIEALNKSFHELSSQNSSDQRYVIA

SEQ ID NO: 1009 - DNA, 612 bp, Drosophila melanogaster (Fruit fly)
  CDS (1)..(612)
atggatccttcaattattgaatttattggcgaaaaatgcatgatcagcataataccgaacttcagcaacgagcctctgcacctgatatacggacctgtgggccctttccgagccggttttcccgtcttcgtgcccctgtggatggccacgcatctgcgcaagcaacaaaagtgccgaattgtacctccagaatggatggacatggatatattggaggaaatcaaggaggaggaaaagcgctcaaagttctttaccaaaatgccctgtgagcattacatggtagtggcccagttggtcatgagcacggctccggatgacgttccgcgttgcgaggagctgcgcactgtgatcaaggacatcttcgacatacgcgagtccaagctgcgcacttcgatcgacgcctttatcaagggagagggcacatatgcaaagctagacaacctcacgcttctggagatccacagcgtgagacccattctgccctattccctggaccacatagcacggtaccagcgcacggccactgcgtctcaaagggacacctccatgctaagtgcatccatggcaggctccagttcgggtccgaacagtaactctctgttttctcagtga

SEQ ID NO: 1010 - protein, 203 aa, Drosophila melanogaster (Fruit fly)
MDPSIIEFIGEKCMISIIPNFSNEPLHLIYGPVGPFRAGFPVFVPLWMATHLRKQQKCRIVPPEWMDMDILEEIKEEEKRSKFFTKMPCEHYMVVAQLVMSTAPDDVPRCEELRTVIKDIFDIRESKLRTSIDAFIKGEGTYAKLDNLTLLEIHSVRPILPYSLDHIARYQRTATASQRDTSMLSASMAGSSSGPNSNSLFSQ

SEQ ID NO: 1011 - DNA, 528 bp, Encephalitozoon cuniculi
  CDS (1)..(528)
atggcgatatcgccggaggagattcttcacattgcctacgaggaactggttgagatagaaccgatgacatcaataccagagctgcgtctcttggagaggacctatcctcctctgatgccactggacatagcaagaattcccctgtatgcagccttgctcctgaagaagtcgaatatgtgcaagataaggcttccttcgtatctgcagctggaaagtcttaagatgtccatggatgtggagatagagaaagccgatgagtactcgtgtatccatccatacttctttcctcttgcaacagagcttctggaaaactgctacaacgtcgagagcatagaggaaagcaagatgattgtggagaagatcaaggagataaggcttgcaaagacgctcaagggcatcaaatgcttggatgggaaggccttgaacatgaacaacataacgctatttgagttcaatgaaattaaggagcttattctcgggtctgcagaagtcggaaggagaattgaggatctggcaaaagaccaatag

SEQ ID NO: 1012 - protein, 175 aa, Encephalitozoon cuniculi
MAISPEEILHIAYEELVEIEPMTSIPELRLLERTYPPLMPLDIARIPLYAALLLKKSNMCKIRLPSYLQLESLKMSMDVEIEKADEYSCIHPYFFPLATELLENCYNVESIEESKMIVEKIKEIRLAKTLKGIKCLDGKALNMNNITLFEFNEIKELILGSAEVGRRIEDLAKDQ

SEQ ID NO: 1013 - DNA, 558 bp, Homo sapiens (Human)
  CDS (1)..(558)
atggacgctgccgaggtcgaattcctcgccgagaaggagctggttaccattatccccaacttcagtctggacaagatctacctcatcgggggggacctggggccttttaaccctggtttacccgtggaagtgcccctgtggctggcgattaacctgaaacaaagacagaaatgtcgcctgctccctccagagtggatggatgtagaaaagttggagaagatgagggatcatgaacgaaaggaagaaacttttaccccaatgcccagcccttactacatggaacttacgaagctcctgttaaatcatgcttcagacaacatcccgaaggcagacgaaatccggaccctggtcaaggatatgtgggacactcgtatagccaaactccgagtgtctgctgacagctttgtgagacagcaggaggcacatgccaagctggataacttgaccttgatggagatcaacaccagcgggactttcctcacacaagcgctcaaccacatgtacaaactccgcacaaacctccagcctctggagagtactcagtctcaggacttctag

SEQ ID NO: 1014 - protein, 185 aa, Homo sapiens (Human)
MDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 1015 - DNA, 558 bp, Mus musculus (Mouse)
  CDS (1)..(558)
atggatgcggccgaggtggagtttttggccgaaaaggagttggtgactatcatcccgaacttcagtctggacaagatctacctgatcgggggggacctggggcccttcaaccccggcttacccgtggacgtgcccctgtggctggccattaacctgaaacagagacagaagtgccgcctgttacctccggaatggatggatgtggagaaactggaacagatgcgtgatgaggagcggaaggaggagacattcaccccagtgcccagcccgcactacatggagatcacgaagctcctgctgaatcatgcttctgacaacatccccaaagcagacaccatccggacactgatcaaagacctgtgggacacacgcatggccaagcttcgagtgtctgctgacagttttgtgcggcagcaagaggcacatgccaagctggacaacctgaccttgatggagatcagcagcagcggggccttcctcacccaggccctcaaccacatgtacaagctccgcacaaacctccagccctccgagagcacccagtcgcaggacttctag

SEQ ID NO: 1016 - protein, 185 aa, Mus musculus (Mouse)
MDAAEVEFLAEKELVTIIPNFSLDKIYLIGGDLGPFNPGLPVDVPLWLAINLKQRQKCRLLPPEWMDVEKLEQMRDEERKEETFTPVPSPHYMEITKLLLNHASDNIPKADTIRTLIKDLWDTRMAKLRVSADSFVRQQEAHAKLDNLTLMEISSSGAFLTQALNHMYKLRTNLQPSESTQSQDF

SEQ ID NO: 1017 - DNA, 558 bp, Xenopus laevis (African clawed frog)
  CDS (1)..(558)
atggatgcctctgaggtcgagttcttggctgagaaggagcaagtgaccgtcatccccaactttagtctggacaaggtctatctcattgggggtgacttgggcccctttaatcctagtttacctgttgaggttcctctgtggttggccatcaacctgaaacaaaggcagaaatgtcgaattgtccctccagagtggatggatgttgagaaactagaggctatccgagaccaagaacgcagagaggagacgtttactccaatgccaagtccctattatatggaacttactaagctattgttaaatcatgctgcagacaatatccctaaagcagatgagattcgtacacttgtaaaagacacctgggatacaagaatagcaaaactgcggctctctgctgacagctttgtgaaggggcaggaagctcatgccaagctggataacctgacgctaatggaaattaacaccatcggaacattttttactgagtctttaaaccacatgtacaagctacgtaccagcctgcagaacccagaggaaggacagtcacaggattactaa

SEQ ID NO: 1018 - protein, 185 aa, Xenopus laevis (African clawed frog)
MDASEVEFLAEKEQVTVIPNFSLDKVYLIGGDLGPFNPSLPVEVPLWLAINLKQRQKCRIVPPEWMDVEKLEAIRDQERREETFTPMPSPYYMELTKLLLNHAADNIPKADEIRTLVKDTWDTRIAKLRLSADSFVKGQEAHAKLDNLTLMEINTIGTFFTESLNHMYKLRTSLQNPEEGQSQDY

SEQ ID NO: 1019 - DNA, 23 bp, Primer
atgtcactaccggcacatttgca

SEQ ID NO: 1020 - DNA, 29 bp, Primer
ttaaatattgaattcttcttcatcatttt

SEQ ID NO: 1021 - DNA, 264 bp, Saccharomyces cerevisiae; identical to SEQ ID NO: 172
  CDS (1)..(264)

SEQ ID NO: 1022 - protein, 87 aa, Saccharomyces cerevisiae; identical to SEQ ID NO: 173

SEQ ID NO: 1023 - DNA, 258 bp, Pectinaria gouldii
  CDS (1)..(258)
atgcagaacgaccagggagaaatcgtggatgtatacatccccaggaagtgctctgccacgaacaacattctggctgcaaaggaccatgcatcagtgcagatcaacatggctgagattgacccccaaactggcaggatgactggcaaacagatcacatatgctctgtgtggagagctcaggaggatgggtgaggctgatgacagtgtaaacagattggcaatgaaagacaaaatgctgtcagaggtcttcggtcattga

SEQ ID NO: 1024 - protein, 85 aa, Pectinaria gouldii; identical to SEQ ID NO: 217

SEQ ID NO: 1025 - DNA, 264 bp, Schizosaccharomyces pombe; identical to SEQ ID NO: 178
  CDS (1)..(264)

SEQ ID NO: 1026 - protein, 87 aa, Schizosaccharomyces pombe; identical to SEQ ID NO: 179

SEQ ID NO: 1027 - DNA, 249 bp, Guillardia theta nucleomorph
  CDS (1)..(249)
atgaattctaccaacaaaaaaattgtaggggaatatatcccgagaaaatgctctttaagtaataaactaatcaataataaagatcatgcttcaattcaaatttcaattggggtcttagataaaaacgatttatttaaaggtgaatatgatatatttgcattttcaggtcttatgagaaaaaaaggtaaatctgattatgcaatagtaaatttaattgaaaaattggataattgtaatttaaaaatttga

SEQ ID NO: 1028 - protein, 82 aa, Guillardia theta nucleomorph; identical to SEQ ID NO: 189

SEQ ID NO: 1029 - DNA, 252 bp, Drosophila melanogaster; identical to SEQ ID NO: 194
  CDS (1)..(252)

SEQ ID NO: 1030 - protein, 83 aa, Drosophila melanogaster [sequence omitted]

SEQ ID NO: 1031 - DNA, 246 bp, Anopheles gambiae
  CDS (1)..(243)
atggagaacgatgctggagagtttgttgatctgtactgcccccgcaagtgctcttcgagcaaccgcatcatccacgctaaggatcatgcctccatccagatcaacatcgtcgacgtagacccggagactggccgcatgctggacacctccaaggtgtacgccatctgcggtgagatccgctgacgtatgggcgaatcggacgattgcatcgttcgtctggccaagaaggacggtatcctgtcctga

SEQ ID NO: 1032 - protein, 80 aa, Anopheles gambiae; identical to SEQ ID NO: 207

SEQ ID NO: 1033 - DNA, 270 bp, Giardia lamblia; identical to SEQ ID NO: 204
  CDS (1)..(270)

SEQ ID NO: 1034 - protein, 89 aa, Giardia lamblia; identical to SEQ ID NO: 205

SEQ ID NO: 1035 - DNA, 249 bp, Oryza sativa
  CDS (1)..(249)
atgcagaacgaggagggtcagatggtggacctctacgtccccaggaagtgctcggccacgaacaggatcatcaccgccaaggaccacgcctcggtccagatcaacattgggcatgtggatgagaatgggctgtacgatggccgcttcaccacctttgctctctctgggttcatccgtgctcagggagatgctgacagtgctctggataggctgtggcagaagaggaaggctgaggtcaagcagcagtag

SEQ ID NO: 1036 - protein, 82 aa, Oryza sativa
MQNEEGQMVDLYVPRKCSATNRIITAKDHASVQINIGHVDENGLYDGRFTTFALSGFIRAQGDADSALDRLWQKRKAEVKQQ

SEQ ID NO: 1037 - DNA, 246 bp, Danio rerio; identical to SEQ ID NO: 214
  CDS (1)..(246)

SEQ ID NO: 1038 - protein, 81 aa, Danio rerio; identical to SEQ ID NO: 215

SEQ ID NO: 1039 - DNA, 258 bp, Branchiostoma belcheri tsingtaunese
  CDS (1)..(258)
atgcagaacgacgcaggtgaagttgtggatctgtacatccctcgcaagtgctcatcaaccaaccgcatcattggtgccaaggatcatgcctcaatccagatcaactttgctgaggttgacccgaccactggccgcatgacaggacagtacaagacttacgccatctgtggctacatcaggcaaatgggagagtccgatgactgtctgaagcgcctggcaataaaggataaaatcattgacgcaaaaatggatgcctag

SEQ ID NO: 1040 - protein, 85 aa, Branchiostoma belcheri tsingtaunese; identical to SEQ ID NO: 203

SEQ ID NO: 1041 - DNA, 252 bp, Ceratitis capitata; identical to SEQ ID NO: 200
  CDS (1)..(252)

SEQ ID NO: 1042 - protein, 83 aa, Ceratitis capitata; identical to SEQ ID NO: 201

SEQ ID NO: 1043 - DNA, 249 bp, Plasmodium falciparum; identical to SEQ ID NO: 198
  CDS (1)..(249)

SEQ ID NO: 1044 - protein, 82 aa, Plasmodium falciparum; identical to SEQ ID NO: 199

SEQ ID NO: 1045 - DNA, 249 bp, Arabidopsis thaliana; identical to SEQ ID NO: 208
  CDS (1)..(249)

SEQ ID NO: 1046 - protein, 82 aa, Arabidopsis thaliana; identical to SEQ ID NO: 209

SEQ ID NO: 1047 - DNA, 252 bp, Ictalurus punctatus; identical to SEQ ID NO: 212
  CDS (1)..(252)

SEQ ID NO: 1048 - protein, 83 aa, Ictalurus punctatus; identical to SEQ ID NO: 213

SEQ ID NO: 1049 - DNA, 252 bp, Spodoptera frugiperda
  CDS (1)..(252)
atgcagaacgacgccggagaattcgttgacttgtactgcccgaggaagtgctcggccagcaaccgtctgatccacgccaaggaccacgcgtccgtgcagctggtgatcgcggacgtggaccccgccacgggccgcgccgccgacacctccaagatgtacgtggtgtgcggagccatccgccgcatgggggagtccgacgactgcatcgtcaggctcaccaagaaggacggcatattggctaagaactactga

SEQ ID NO: 1050 - protein, 83 aa, Spodoptera frugiperda; identical to SEQ ID NO: 197

SEQ ID NO: 1051 - DNA, 273 bp, Homo sapiens
  CDS (1)..(273)
atgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtag

SEQ ID NO: 1052 - protein, 90 aa, Homo sapiens; identical to SEQ ID NO: 193

SEQ ID NO: 1053 - DNA, 201 bp, Homo sapiens
  CDS (1)..(201)
atgcagaacgacgccggcgagttcgtggacctgtacgtgccgcggaaatgctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtga

SEQ ID NO: 1054 - protein, 66 aa, Homo sapiens; identical to SEQ ID NO: 191

SEQ ID NO: 1055 - DNA, 252 bp, Rattus norvegicus
  CDS (1)..(252)
atgcagaacgacgccggcgagtttgtggacctgtacgtgccgcggaaatgctccgcgagcaaccgcatcattgctgccaaggaccacgcgtccatccagatgaatgtggccgaggttgacaggagtacaggccgatttaatggtcagtttaaaacctacggcatctgcggggccattcgcaggatgggcgagtcagatgattctattctccgattggctaaggctgatggaattgtctcaaagaacttttga

SEQ ID NO: 1056 - protein, 83 aa, Rattus norvegicus; identical to SEQ ID NO: 177

SEQ ID NO: 1057 - DNA, 267 bp, Caenorhabditis elegans
  CDS (1)..(267)
atgcaaaacgacgccggacaaaccgtcgagctttacgttccacgcaagtgctcttcgtccaaccgcatcatcggaccaaaggaccacgcttccgtccaaatcgatttcgtcgatgtcgacccagagactggccgcatgatcccaggaaagtctacccgctacgccatctgtggagctatccgccgcatgggagaatccgacgacgctatcttgagacttgcccagaaggacggactcgtgccaagagatgatgttaagtccaactga

SEQ ID NO: 1058 - protein, 88 aa, Caenorhabditis elegans; identical to SEQ ID NO: 219

SEQ ID NO: 1059 - DNA, 264 bp, Candida albicans; identical to SEQ ID NO: 220
  CDS (1)..(264)

SEQ ID NO: 1060 - protein, 87 aa, Candida albicans; identical to SEQ ID NO: 221

SEQ ID NO: 1061 - DNA, 332 bp, Cyanophora paradoxa
  CDS (1)..(249)
atgcagaacgacgagggcaagattgtggacctgtacatcccgcggaagtgctccgcgaccaaccggctgatctcggccacggaccacgccgccgtccagatcaacgtcggccacgttgacccgaactctggcctgtacactggtgactacaccacgttcgccctgtgcggcttcgttcgcagcatgggcgagtcggacgccgcgctcaaccgcctgtgcgtgaagcacgggctggcgaaggccatttaagcagccttcaacattgtgtcccgtttcttggaggatgtaacaatgacacgaatgccccccctttcaaaaaaaaaaaaaaaaaa

SEQ ID NO: 1062 - protein, 82 aa, Cyanophora paradoxa; identical to SEQ ID NO: 223

SEQ ID NO: 1063 - DNA, 252 bp, Mus musculus
  CDS (1)..(252)
atgcagaacgacgccggcgagtttgtggacctgtacgtgccgcggaaatgctccgcaagcaaccgcatcattgctgccaaggaccacgcgtccatccagatgaacgtggccgaggttgataggaccacaggccggtttaatggccagtttaaaacctatggcatctgcggggccattcgcaggatgggcgagtcagatgattctattctccgattggctaaggctgatggaattgtctcaaagaacttttga

SEQ ID NO: 1064 - protein, 83 aa, Mus musculus; identical to SEQ ID NO: 225

SEQ ID NO: 1065 - DNA, 264 bp, Neurospora crassa; identical to SEQ ID NO: 226
  CDS (1)..(264)

SEQ ID NO: 1066 - protein, 87 aa, Neurospora crassa; identical to SEQ ID NO: 227

SEQ ID NO: 1067 - DNA, 252 bp, Homo sapiens
  CDS (1)..(252)
atgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttga

SEQ ID NO: 1068 - protein, 83 aa, Homo sapiens; identical to SEQ ID NO: 181

SEQ ID NO: 1069 - DNA, 294 bp, Homo sapiens; identical to SEQ ID NO: 182
  CDS (1)..(294)

SEQ ID NO: 1070 - protein, 97 aa, Homo sapiens; identical to SEQ ID NO: 183

SEQ ID NO: 1071 - DNA, 246 bp, Zea mays; identical to SEQ ID NO: 184
  CDS (1)..(246)

SEQ ID NO: 1072 - protein, 81 aa, Zea mays; identical to SEQ ID NO: 185

SEQ ID NO: 1073 - DNA, 264 bp, Schizosaccharomyces pombe; identical to SEQ ID NO: 178
  CDS (1)..(264)

SEQ ID NO: 1074 - protein, 87 aa, Schizosaccharomyces pombe; identical to SEQ ID NO: 179

SEQ ID NO: 1075 - DNA, 25 bp, Primer
atggaaaacgataagggccaattag

SEQ ID NO: 1076 - DNA, 24 bp, Primer
ttaacgtgagtaagaccagacgtt

SEQ ID NO: 1077 - DNA, 345 bp, Saccharomyces cerevisiae
  CDS (1)..(345)
atgtctgaagtaattgaaggtaacgtcaaaattgacagaatttccccaggtgatggtgccaccttcccaaagacaggtgacttggttaccattcattacaccggtaccttggagaacggccaaaaattcgattcctccgttgacaggggctctccattccaatgtaacatcggtgtcggccaagtcatcaagggttgggatgttggtattccaaagttgtctgttggtgaaaaagctaggttaaccatccctggcccatatgcttatggcccacgtggtttcccaggtttgattccaccaaacagtactttggttttcgacgtcgaattgttgaaggtcaactaa

SEQ ID NO: 1078 - protein, 114 aa, Saccharomyces cerevisiae
MSEVIEGNVKIDRISPGDGATFPKTGDLVTIHYTGTLENGQKFDSSVDRGSPFQCNIGVGQVIKGWDVGIPKLSVGEKARLTIPGPYAYGPRGFPGLIPPNSTLVFDVELLKVN

SEQ ID NO: 1079 - DNA, 342 bp, Pseudomonas aeruginosa
  CDS (1)..(342)
atgaacgaccgactgcagatcgaagacctcctcctgggcgacggcaaggaggtagtgaagggtgcgctgatcaccacccagtacaagggcaccctggaagacggcacgctgttcgactcctcctacgagcgcggccggccattccagtgcgtgatcggcaccggacgagtgatcaagggttgggaccagggcctgatgggcatgaaggtcggtggcaagcgacggctgttcgtcccttcccacctggcctacggcgaacggcaggtcggcgcgcacatcaagccccactccaacctgctgttcgagatcgaactgctggaagtgctcacccgcgacgactga

SEQ ID NO: 1080 - protein, 113 aa, Pseudomonas aeruginosa
MNDRLQIEDLLLGDGKEVVKGALITTQYKGTLEDGTLFDSSYERGRPFQCVIGTGRVIKGWDQGLMGMKVGGKRRLFVPSHLAYGERQVGAHIKPHSNLLFEIELLEVLTRDD

SEQ ID NO: 1081 - DNA, 498 bp, Nostoc sp. PCC 7120
  CDS (1)..(498)
atgctggcctgtgttgtggttttggtattggcacaagtggggaataaacaggactctgctattgctgctaatttacctcaaactccactagccaccattagcgttactgaaaacaatactccaatcaagaaaaatatcatgtctgaagcctctaagccgcctgttactaccgattctggactcaaatatgtggaaatagaagagggaactggcgcgactcctaaaagtggacaaaccgtcgtagttcactacacaggtactctagaagatggtaccaagtttgatagctcacgcgatcgcaatcgtcccttcagctttaccatcggcgttggacaagtaattaaaggttgggatgaaggacttagcactatgaaagtaggtggtcgtcgtcaattaatcatcccttcagaattgggttatggcgctcgtggtgctggtggggtgattccaccttacgcaaccctgctgtttgatgtggaattgttggaagtgaagtag

SEQ ID NO: 1082 - protein, 165 aa, Nostoc sp. PCC 7120
MLACVVVLVLAQVGNKQDSAIAANLPQTPLATISVTENNTPIKKNIMSEASKPPVTTDSGLKYVEIEEGTGATPKSGQTVVVHYTGTLEDGTKFDSSRDRNRPFSFTIGVGQVIKGWDEGLSTMKVGGRRQLIIPSELGYGARGAGGVIPPYATLLFDVELLEVK

SEQ ID NO: 1083 - DNA, 459 bp, Deinococcus radiodurans
  CDS (1)..(459)
atgaccgctgcttcatacgccgggcagctgactttttccacttctcatctctctacctgcgaccctcacgaccttcacgggtgttttactgagttcctggccagtggacgggcgcgttactctcggcgcatgactcaggatttacaagtcgagaaataccaggaaggcagcggccagccggcagaaaaaggcaagatggtcagcgtgcactacacaggcacgctggaaaacggccagaagttcgactccagccgcgaccggggccagcccatcgagttcccgctcggcgtcggctacgtgattcccggctgggaccagggcatcgcgcagatgcgggtgggcgacaaggcccggctgaccatccccggccacctcgcctacggtgaagcgggcgttcccggcgtcattccccccaacgccaccctgattttcgacgtggaactgatggacgtgcgctga

SEQ ID NO: 1084 - protein, 152 aa, Deinococcus radiodurans
MTAASYAGQLTFSTSHLSTCDPHDLHGCFTEFLASGRARYSRRMTQDLQVEKYQEGSGQPAEKGKMVSVHYTGTLENGQKFDSSRDRGQPIEFPLGVGYVIPGWDQGIAQMRVGDKARLTIPGHLAYGEAGVPGVIPPNATLIFDVELMDVR

SEQ ID NO: 1085 - DNA, 534 bp, Caulobacter crescentus
  CDS (1)..(534)
atgttagctggacggcgtattttgatcgaggttcccatgcatcgccgcgccctgctcgtcaccctcgccgccgccggagtggccctttcggcctgcggacccagcaagaaggcgcaggagaacctagcggccgccgacgccttcatggccaagaacgccaaggagccgggcgtcgtcaccctgccgcagggcctgcagtacaaggtcgtgcgcgaaggcccgaacggcggcatgcacccgaacaaggccgacgaggtcaaggttcactacgagggcaagctgatcgacggcacggtgttcgattccagctacgagcgcggcgtgccggccgtgttcccgctggacgggctggtgcccgcttgggtcatcgccctgcagcgcatgaaggcgggcgatgagtggatcctctatgtgccgccggccctgggctatggcgcgcaggacaaggggccgatcccgggcaacagcgtgatgatcttccggatcgaactgctcgacgtgaaccgcatcggtccgggcaagccgaaggaatga

SEQ ID NO: 1086 - protein, 177 aa, Caulobacter crescentus
MLAGRRILIEVPMHRRALLVTLAAAGVALSACGPSKKAQENLAAADAFMAKNAKEPGVVTLPQGLQYKVVREGPNGGMHPNKADEVKVHYEGKLIDGTVFDSSYERGVPAVFPLDGLVPAWVIALQRMKAGDEWILYVPPALGYGAQDKGPIPGNSVMIFRIELLDVNRIGPGKPKE

SEQ ID NO: 1087 - DNA, 474 bp, Vibrio cholerae
  CDS (1)..(474)
atgtcgaaaattattatccctttagttgttttcttgctcgcaggtttcatgatttaccgtacttggactaatcataagtcggcagatgccaatttttctgctgggcagcagtttttggctgagaatggacaacgcgaaaacgtcatcactaccgatagtggtttgcaatacgaagtgctgcaggcgggaacggggactgaacatccggggccaaaaagccgcgtgaaagtgcattaccatggtgagttgcttgatggtacggtgtttgatagctcggttgaacgtggtgaacccatcagttttggcttgaatcaagttatcaaaggttggcaagagggcgtgcaactgatggtagtcggtgaaaagactcgcttctatatcccaagcaacttgggttatggcaaaaatggcgcaggcccaatcccaccttctgctgtactgatctttgacgtcgagctactggcgattgagtaa

SEQ ID NO: 1088 - protein, 157 aa, Vibrio cholerae
MSKIIIPLVVFLLAGFMIYRTWTNHKSADANFSAGQQFLAENGQRENVITTDSGLQYEVLQAGTGTEHPGPKSRVKVHYHGELLDGTVFDSSVERGEPISFGLNQVIKGWQEGVQLMVVGEKTRFYIPSNLGYGKNGAGPIPPSAVLIFDVELLAIE

SEQ ID NO: 1089 - DNA, 330 bp, Neisseria meningitidis
  CDS (1)..(330)
atgggcagcctgattattgaagatttgcaggaaggcttcggaaaagaagcagttaaaggcaaagagattaccgtgcattacacaggttggctggaaaacggaaccaaattcgactccagcctcgaccgccgccagccgctgaccatcacgctcggtgtcggacaagtcatcaaaggctgggacgaaggcttcggcggcatgaaggaaggcggcaaacgcaagctgaccatcccttcggaaatgggctacggcgcacgcggcgcgggcggcgtgattcctccgcacgccactttgatatttgaagtcgagctgctgaaagtgtacgaataa

SEQ ID NO: 1090 - protein, 109 aa, Neisseria meningitidis
MGSLIIEDLQEGFGKEAVKGKEITVHYTGWLENGTKFDSSLDRRQPLTITLGVGQVIKGWDEGFGGMKEGGKRKLTIPSEMGYGARGAGGVIPPHATLIFEVELLKVYE

SEQ ID NO: 1091 - DNA, 330 bp, Neisseria meningitidis
  CDS (1)..(330)
atgggcggcctgattattgaagacttgcaagaaggcttcggaaaagaagcagttaaaggcaaagagattaccgtgcattacacaggttggctggaaaacggaaccaaattcgactccagcctcgaccgccgccagccgctgaccatcacgctcggtgtcggacaagtcatcaaaggctgggacgaaggcttcggcggcatgaaggaaggcggcaaacgcaagctgaccatcccttcggaaatgggctacggcgcacacggcgcgggcggcgtgattcccccgcacgccactttgatatttgaagtcgagctgctgaaagtgtacgaatag

SEQ ID NO: 1092 - protein, 109 aa, Neisseria meningitidis
MGGLIIEDLQEGFGKEAVKGKEITVHYTGWLENGTKFDSSLDRRQPLTITLGVGQVIKGWDEGFGGMKEGGKRKLTIPSEMGYGAHGAGGVIPPHATLIFEVELLKVYE

SEQ ID NO: 1093 - DNA, 504 bp, Arabidopsis thaliana (mouse-ear cress)
  CDS (1)..(504)
atgcttttggtactcggcgtctcaggaggattatcaatgagctcacttgcggcgtatgcagctggtttacctccagaagataaaccaagactctgtgaagcagaatgcgagaaagagcttgaaaatgttccaatggtaactacagagtcagggcttcagtataaggatattaaagttggtagaggcccgagtccaccggttggttttcaggttgctgctaattatgtggctatggttccatcagggcaaatattcgacagttctctggagaaaggtctaccgtatctatttcgcgttggctctggccaggtgatcaaaggacttgatgaaggaatcttgagtatgaaagctggtggcaaacgtagactctacatcccagggcctttggcgtttccaaagggtctagtttcagctccagggaggccgagagttgcgccaaacagcccggtgatatttgacgtgagcttagagttcataccaggtctcgattcagaggaagagtga

SEQ ID NO: 1094 - protein, 167 aa, Arabidopsis thaliana (mouse-ear cress)
MLLVLGVSGGLSMSSLAAYAAGLPPEDKPRLCEAECEKELENVPMVTTESGLQYKDIKVGRGPSPPVGFQVAANYVAMVPSGQIFDSSLEKGLPYLFRVGSGQVIKGLDEGILSMKAGGKRRLYIPGPLAFPKGLVSAPGRPRVAPNSPVIFDVSLEFIPGLDSEEE

SEQ ID NO: 1095 - DNA, 345 bp, Caulobacter crescentus
  CDS (1)..(345)
atggtcagcctgccgtcgggcctgcagtacaaggtcatcgcctcgggccccaaggacggcccctcgccgaagctgggcgacatcatcaaggtcaattacgagggcaagctgctgagcggcgcggtcttcgactcaagcttcgcgcgcggcaaggcggcgatcatgcccgccgacggcctgatccggggctggctggaggccctgccgctgatgaaggtgggcgacgagtggacgctcttcatcccaccggagctgggctacggctcgcgcgacatgggcgagatcccgcccgacagcaccctggtgttccgcctgaagctggaggggatgctgtcggtggattga

SEQ ID NO: 1096 - protein, 114 aa, Caulobacter crescentus
MVSLPSGLQYKVIASGPKDGPSPKLGDIIKVNYEGKLLSGAVFDSSFARGKAAIMPADGLIRGWLEALPLMKVGDEWTLFIPPELGYGSRDMGEIPPDSTLVFRLKLEGMLSVD

SEQ ID NO: 1097 - DNA, 357 bp, Corynebacterium glutamicum
  CDS (1)..(357)
atggaaaagccacagattgagctaccggtcggtccagcaccggaagatctcgtaatctctgacatcatcgttggcgaaggagcagaagcccgcccaggtggagaagttgaggtccactatgtgggcgttgactttgaaaccggcgaggagtttgactcttcctgggatcgtggacagaccagccagttcccactcaacggcctcattgcaggttggcaagagggaattccaggcatgaaggtcggcggacgtcgtcagctgaccattccgccagaggctgcttacggccctgagggttccggccacccactgtctggccgtaccctggtgttcatcatcgatttgatcagcgcataa

SEQ ID NO: 1098 - protein, 118 aa, Corynebacterium glutamicum
MEKPQIELPVGPAPEDLVISDIIVGEGAEARPGGEVEVHYVGVDFETGEEFDSSWDRGQTSQFPLNGLIAGWQEGIPGMKVGGRRQLTIPPEAAYGPEGSGHPLSGRTLVFIIDLISA

SEQ ID NO: 1099 - DNA, 423 bp, Mus musculus (house mouse)
  CDS (1)..(423)
atgaggctgagctggatcctgacaatactgtccatttgcctgagtgccctggcagcagccacgggggccgaaggcaaacggaagctgcagattggagtgaagaaacgtgtggaccactgtcctatcaagtctagaaagggagatgtcttacacatgcactacacgggaaagctagaagatgggacggagtttgacagcagcctaccacagaaccagccctttgttttctcccttggcactggccaggttatcaagggctgggaccaggggctgctggggatgtgtgaaggggaaaagcggaagttggtgatcccatccgagctggggtatggagagcggggagcccccccaaagatcccaggtggagcaaccctggtgtttgaggtggagctgctcaagattgagagacgctcagaactgtag

SEQ ID NO: 1100 - protein, 140 aa, Mus musculus (house mouse)
MRLSWILTILSICLSALAAATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRSEL

SEQ ID NO: 1101 - DNA, 429 bp, Homo sapiens (man)
  CDS (1)..(429)
atgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtag

SEQ ID NO: 1102 - protein, 142 aa, Homo sapiens (man)
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 1103 - DNA, 327 bp, Homo sapiens (man)
  CDS (1)..(327)
atgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtga

SEQ ID NO: 1104 - protein, 108 aa, Homo sapiens (man)
MGVEIETISPGDGRTFPKKGQTCVVHYTGMLQNGKKFDSSRDRNKPFKFRIGKQEVIKGFEEGAAQMSLGQRAKLTCTPDVAYGATGHPGVIPPNATLIFDVELLNLE

SEQ ID NO: 1105 - DNA, 327 bp, Mus musculus (house mouse)
  CDS (1)..(327)
atgggagtgcaggtggagaccatctctcctggagacgggcgcaccttcccaaagcgcggccagacctgcgtggtgcactacacggggatgcttgaagatggaaagaaatttgattcctctcgggacagaaacaagccttttaagtttacactaggcaagcaggaggtgatccgaggctgggaggaaggggtagcccagatgagtgtgggtcagagagccaaactgataatctcctcagactatgcctatggagccaccgggcacccaggcatcatcccaccacatgccactcttgtttttgatgtggagcttctaaaactggaatga

SEQ ID NO: 1106 - protein, 108 aa, Mus musculus (house mouse)
MGVQVETISPGDGRTFPKRGQTCVVHYTGMLEDGKKFDSSRDRNKPFKFTLGKQEVIRGWEEGVAQMSVGQRAKLIISSDYAYGATGHPGIIPPHATLVFDVELLKLE

SEQ ID NO: 1107 - DNA, 405 bp, Botryllus schlosseri
  CDS (1)..(405)
atgagattgttacctttagttgcgtgcgtcgcagttttctgtgtgacggtgcatgcgaaagtagacaaactgcaaatcggagtcttgaaacgggtggaatgcgaacgtaaaagcgggagcggagatgtgctcgatatgcattacaccggtacgctggaagatgggtcgaaattcgacagctcacgggaccgcgatactcctttcaccttcactctaggtcaagggtatgtcatcaagggttgggacaaaggtcttctcggaatgtgtgaaggagagcgaagaaagttgaagattcccagcgacatgggatacggtgatcgtggatctccgcctaagataccaggtggcgccaccctcatcttcgatgtagagttgttgaagatcaaagataaagacgagctttga

SEQ ID NO: 1108 - protein, 134 aa, Botryllus schlosseri
MRLLPLVACVAVFCVTVHAKVDKLQIGVLKRVECERKSGSGDVLDMHYTGTLEDGSKFDSSRDRDTPFTFTLGQGYVIKGWDKGLLGMCEGERRKLKIPSDMGYGDRGSPPKIPGGATLIFDVELLKIKDKDEL

SEQ ID NO: 1109 - DNA, 363 bp, Neurospora crassa
  CDS (1)..(363)
atgactattccccagcttgacggtcttcagatcgaggtccagcaggagggccagggcacccgtgagacccgtcgcggcgacaacgtcgacgtccactacaagggtgtcctcaccagcggtaagaagttcgacgctagctacgaccgtggcgagcctctcaacttcaccgttggccagggccaggtcatcaagggctgggatgagggtctcctcggcatgaagattggcgagaagcgcaagctcactatcgcccctcacctcgcctacggcaaccgcgccgtcggtggcatcatccccgccaactccaccctcatcttcgagaccgagctcgtcggtatcaagggtgtccagaagggcgagtaa

SEQ ID NO: 1110 - protein, 120 aa, Neurospora crassa
MTIPQLDGLQIEVQQEGQGTRETRRGDNVDVHYKGVLTSGKKFDASYDRGEPLNFTVGQGQVIKGWDEGLLGMKIGEKRKLTIAPHLAYGNRAVGGIIPANSTLIFETELVGIKGVQKGE

SEQ ID NO: 1111 - DNA, 408 bp, Saccharomyces cerevisiae
  CDS (1)..(408)
atgatgtttaatatttaccttttcgtcacttttttttccaccattcttgcaggttccctgtcagatttggaaatcggtattatcaagagaataccggtagaagattgcttaattaaggcaatgccaggtgataaagttaaggttcattatacaggatctttattagaatcgggaactgtatttgactcaagttattcaagaggctctcctatcgcttttgaacttggcgttggcagagtaattaaaggttgggatcaaggtgttgccggcatgtgcgttggcgaaaaaagaaagctgcaaattccaagttctttggcctacggagaaagaggtgtcccaggcgtcattcctccaagtgctgatttggtgtttgatgtcgaattggtagacgtgaaatcagccgcctag

SEQ ID NO: 1112 - protein, 135 aa, Saccharomyces cerevisiae
MMFNIYLFVTFFSTILAGSLSDLEIGIIKRIPVEDCLIKAMPGDKVKVHYTGSLLESGTVFDSSYSRGSPIAFELGVGRVIKGWDQGVAGMCVGEKRKLQIPSSLAYGERGVPGVIPPSADLVFDVELVDVKSAA

SEQ ID NO: 1113 - DNA, 327 bp, Drosophila melanogaster
  CDS (1)..(327)
atgggagtacaagtagttccaattgctcctggtgatggcagcacctatcccaagaatggccaaaaggtcacggtccactacaccggcaccctggacgatggcaccaagttcgattcgtcgcgcgaccgcaacaagccattcaagttcaccatcggcaagggcgaggtcatccgtggctgggatgagggagttgcccagttgagcgtcggccagagcgccaagctgatttgctcgccggactatgcctacggtagccgtggccaccccggcgtcattccgcccaactccaccctcaccttcgacgtcgagctgctcaaggtcgaatag

SEQ ID NO: 1114 - protein, 108 aa, Drosophila melanogaster
MGVQVVPIAPGDGSTYPKNGQKVTVHYTGTLDDGTKFDSSRDRNKPFKFTIGKGEVIRGWDEGVAQLSVGQSAKLICSPDYAYGSRGHPGVIPPNSTLTFDVELLKVE

SEQ ID NO: 1115 - DNA, 456 bp, Vicia faba (fava bean)
  CDS (1)..(456)
atgaagctattttcaattttccttatcttcaccatcttcatcattgcatcagcattagttgctgcgaagagtgctgctgatgtaacggagttgcagattggcgttaagtataaaccagcatcatgtgaagtccaggcacacaaaggcgataaagtgaaagtacactaccggggaaaactcactgatggaactgtattcgattctagctttgaaagaaatagtccgattgattttgagcttggtggtggtcaagtgatcaaaggatgggaccaaggattattgggaatgtgtcttggtgagaagcgaaaactgaaaatcccagcaaaacttggctatggagagcagggttccccaccaactattccaggtggtgcaacacttatatttgacactgagcttgtgggagtgaacgacaaaagcttaagcgaagaaaaatcaacctcgtccgaactgtag

SEQ ID NO: 1116 - protein, 151 aa, Vicia faba (fava bean)
MKLFSIFLIFTIFIIASALVAAKSAADVTELQIGVKYKPASCEVQAHKGDKVKVHYRGKLTDGTVFDSSFERNSPIDFELGGGQVIKGWDQGLLGMCLGEKRKLKIPAKLGYGEQGSPPTIPGGATLIFDTELVGVNDKSLSEEKSTSSEL

SEQ ID NO: 1117 - DNA, 339 bp, Vicia faba (fava bean)
  CDS (1)..(339)
atgggtgttgagaagcaaatcataagagctggaaccggtcccaaccctagccgcggccagaacgtcaccgttcactgcaccggttacggtaaaaacggtgacctttctcagaagttctggagcacgaaggatcctggccagaatccattcactttcaaaatcggccaaggttctgtcatcaaaggatgggatgaaggtgtccttggcatgcaactcggcgaagttgctcgtcttcggtgctctcctgattatgcctatggtgctggtggttttcctgcctggggaatacagcccaactctgtcttggagtttgagatcgaggtcttaagggcacaatga

SEQ ID NO: 1118 - protein, 112 aa, Vicia faba (fava bean)
MGVEKQIIRAGTGPNPSRGQNVTVHCTGYGKNGDLSQKFWSTKDPGQNPFTFKIGQGSVIKGWDEGVLGMQLGEVARLRCSPDYAYGAGGFPAWGIQPNSVLEFEIEVLRAQ

SEQ ID NO: 1119 - DNA, 420 bp, Caenorhabditis elegans
  CDS (1)..(420)
atgaaaaccgctgttatcgttggacttttgtgcctattggcgatcgcatatgctgccgatgagcagaaaatcgataaattgcaaattggagtcaagaagcgtgccgagaactgcgttcagaaatccagaaagggtgatcaattgcacatgcactacaccggaacccttctcgatggaactgaatttgattccagccgcactcgcaatgaagaattcactttcactcttggacaaggaaatgtgatcaagggatgggatcaaggacttcttaacatgtgcgtcggagagcgtcgtattctcacaattccaccacaccttggatacggagaacgtggagccccaccaaagattccaggcaactctgtcctcaagttcgacgttgagctcatgaagattgacagagacggagaagaattgtaa

SEQ ID NO: 1120 - protein, 139 aa, Caenorhabditis elegans
MKTAVIVGLLCLLAIAYAADEQKIDKLQIGVKKRAENCVQKSRKGDQLHMHYTGTLLDGTEFDSSRTRNEEFTFTLGQGNVIKGWDQGLLNMCVGERRILTIPPHLGYGERGAPPKIPGNSVLKFDVELMKIDRDGEEL

SEQ ID NO: 1121 - DNA, 327 bp, Caenorhabditis elegans
  CDS (1)..(327)
atgggcgtcgacagacagattctcgtcgagggcgacaacgtcaccaagccaaagaacggtcagaccgtcacctgccactacgtgctcacccttgagaacggaaagaagatcgactcttctcgcgaccgcggaactccattcaagttcaagattggaaagggagaggtcatcaagggatgggaccaaggagtcgcccagatgtcagttggtgagaagtcgaagctcaccatctctgccgatcttggctatggaccacgcggagttccaccacaaatcccagccaacgcaactctcgtcttcgaggtcgagcttctcggagtcaactaa

SEQ ID NO: 1122 - protein, 108 aa, Caenorhabditis elegans
MGVDRQILVEGDNVTKPKNGQTVTCHYVLTLENGKKIDSSRDRGTPFKFKIGKGEVIKGWDQGVAQMSVGEKSKLTISADLGYGPRGVPPQIPANATLVFEVELLGVN

SEQ ID NO: 1123 - DNA, 339 bp, Schizosaccharomyces pombe
  CDS (1)..(339)
atgggtgtcgaaaagcaagttatttcttccggaaatggtcaagactttcccaaacctggtgacagaatcaccatgcattataccggtactttaaccaatggtaaaaagtttgattcatctgttgaccgtggatccccatttgtttgcactattggcgttggtcaattaattcgcggatgggacgaaggagtacccaaaatgagtttgggtgagaaagctaagcttactatcactcctgattatggctatggcccacgtggtttccctggattgattcctcctaacagcactcttcttttcgatgttgagttgcttgctatcaatgataagaaggcttaa

SEQ ID NO: 1124 - protein, 112 aa, Schizosaccharomyces pombe
MGVEKQVISSGNGQDFPKPGDRITMHYTGTLTNGKKFDSSVDRGSPFVCTIGVGQLIRGWDEGVPKMSLGEKAKLTITPDYGYGPRGFPGLIPPNSTLLFDVELLAINDKKA

SEQ ID NO: 1125 - DNA, 480 bp, Thermococcus sp.
  CDS (1)..(480)
atgaaagttgaagctggtgattatgttctcttccactacgttggaaggttcgaggatggagaagtttttgacacaagctacgaggagatagccagagagaatggcattctcgtcgaggagagggagtacggcccaatgtgggtcaggataggcgtcggtgagatcatccctggcctcgatgaagccataattggcatggaagctggagagaagaagaccgtgaccgttccccccgagaaggcttacggaatgccgaacccagagcttgtaatctccgttccaagggaagaattcacaaaggccggccttgaaccccaggaaggtctctacgtcatgaccgattctggcatagccaagatagtttccgttggagagagcgaggtatcccttgacttcaaccacccgctagcaggtaagaccctagtctttgaggtagaagtcatagaagtaaaaaaggccgaagaggactcagaagcttag

SEQ ID NO: 1126 - protein, 159 aa, Thermococcus sp.
MKVEAGDYVLFHYVGRFEDGEVFDTSYEEIARENGILVEEREYGPMWVRIGVGEIIPGLDEAIIGMEAGEKKTVTVPPEKAYGMPNPELVISVPREEFTKAGLEPQEGLYVMTDSGIAKIVSVGESEVSLDFNHPLAGKTLVFEVEVIEVKKAEEDSEA

SEQ ID NO: 1127 - DNA, 1107 bp, Aequorea victoria (Jellyfish)
  CDS (1)..(1107)
atgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagaattctgcagatatccagcacagtggcggccgctcgagtctagaggagtgcaggtggaaaccatctccccgggagacgggcgcaccttccccaagcgcggccagacctgcgtggtgcactacaccgggatgcttgaagatggaaagaaaatggattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaactagaggagtgcaggtggaaaccatctccccgggagacgggcgcaccttccccaagcgcggccagacctgcgtggtgcactacaccgggatgcttgaagatggaaagaaaatggattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaaactagagggcccttcgaaggtaagcctatccctaaccctctcctcggtctcgattctacgcgtaccggtcatcatcaccatcaccattga

SEQ ID NO: 1128 - protein, 368 aa, Aequorea victoria (Jellyfish)
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEEFCRYPAQWRPLESRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETRGVQVETISPGDGRTFPKRGQTCVVHYTGMLEDGKKMDSSRDRNKPFKFMLGKQEVIRGWEEGVAQMSVGQRAKLTISPDYAYGATGHPGIIPPHATLVFDVELLKLETRGPFEGKPIPNPLLGLDSTRTGHHHHHH

SEQ ID NO: 1129 - DNA, 1092 bp, Aequorea victoria (Jellyfish)
  CDS (1)..(1092)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctagtgaccaccctgtcttacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctcctagggttcgtgaccgccgccgggatcactctcggcatggacgagctgtacaagtccggactcagatctcgaatcacaagtttgtacaaaaaagcaggctccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatga

SEQ ID NO: 1130 - protein, 363 aa, Aequorea victoria (Jellyfish)
MVSKGEELFTGVVPILVELDGDVNGHKFSVSGEGEGDATYGKLTLKFICTTGKLPVPWPTLVTTLSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLGFVTAAGITLGMDELYKSGLRSRITSLYKKAGSMGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1131 - DNA, 339 bp, Arabidopsis thaliana (Mouse-ear cress)
  CDS (1)..(339)
atgggtgtggagaagcaagtcatcagacccggcaacggtcccaaacccgctccgggccaaaccgtcaccgtccattgcaccggattcgggaaagatggtgatctatcccagaagttctggagtacaaaggacgagggacaaaaacctttctcgttccaaatcggtaaaggtgctgtgatcaaaggatgggatgaaggcgttatcggaatgcaaattggagaggttgctcgcttgcggtgctcatcggattacgcatatggcgctggtggatttccggcatgggggatccagccaaactctgttctcgactttgaaatcgaagtactgagcgtgcagtaa

SEQ ID NO: 1132 - protein, 112 aa, Arabidopsis thaliana (Mouse-ear cress)
MGVEKQVIRPGNGPKPAPGQTVTVHCTGFGKDGDLSQKFWSTKDEGQKPFSFQIGKGAVIKGWDEGVIGMQIGEVARLRCSSDYAYGAGGFPAWGIQPNSVLDFEIEVLSVQ

SEQ ID NO: 1133 - DNA, 327 bp, Cryptococcus neoformans (Filobasidiella neoformans)
  CDS (1)..(327)
atgggtgttactgttgagaacatttccgccggtgacggcaagaccttcccccagcctggagacaatgttactatccactacgttggtacccttcttgacggttccaagtttgactcttcccgagaccgtggaacgcccttcgtctgccgaattggccaaggccaagttatcaggggttgggacgagggtgttcctcagctctccgtaggccagaaggctaacctcatctgtacccctgactatgcctacggtgcgcgaggtttcccccctgttattcctcccaactccaccctcaagttcgaggttgagctcctcaaggtcaactaa

SEQ ID NO: 1134 - protein, 108 aa, Cryptococcus neoformans (Filobasidiella neoformans)
MGVTVENISAGDGKTFPQPGDNVTIHYVGTLLDGSKFDSSRDRGTPFVCRIGQGQVIRGWDEGVPQLSVGQKANLICTPDYAYGARGFPPVIPPNSTLKFEVELLKVN

SEQ ID NO: 1135 - DNA, 414 bp, Dirofilaria immitis (Canine heartworm)
  CDS (1)..(414)
atggtgaaatatagcgttgcctccatattactggttttcgtcgcagttgattgtgacgatagggaattggttcgtttgcaaataggagtcaagaagcgtgccgataattgtgagattagatcaagaaaaggagacattataaacgtgccctatgtgggaatgttagaggatggtaccgaattcgatagtagccgatctcgcaataatccattcatattcacgcttggcatgggacaagtcattaagggttgggatcaaggactgctgaacatgtgcgagggcgaacaacgccgtcttgcaattccatctgatctagcctacggcatttccggttctccgccgaaaattccacccgataccagtttgaaattcgatatcgagttgcttaagattgaacccgaagcagatttatag

SEQ ID NO: 1136 - protein, 137 aa, Dirofilaria immitis (Canine heartworm)
MVKYSVASILLVFVAVDCDDRELVRLQIGVKKRADNCEIRSRKGDIINVPYVGMLEDGTEFDSSRSRNNPFIFTLGMGQVIKGWDQGLLNMCEGEQRRLAIPSDLAYGISGSPPKIPPDTSLKFDIELLKIEPEADL

SEQ ID NO: 1137 - DNA, 414 bp, Brugia malayi (Filarial nematode worm)
  CDS (1)..(414)
atgttaaagtgcagtgttgtcctattagtactagttttggtcatggtttgttgcgacgacaaggaattagcccgtttgcaaataggagtcaagaagcgtgtcgacaactgcgagataagatcaagaaagggagatactctgaacgtgcactacgtggggatgttagaggacggtaccgaattcgacaatagtaggtctcgcaataagccattcatattcacgctcggcatgggacaagttattaagggatgggaccaaggactattgaacatgtgcgagggcgaacaacgtcgtcttgcaaccccacctgatctggcatatggcagttccggttctccgccgaaaattccggccgatgccagtttgaaattcgatatcgagttgcttaagattgaacgcgaaggagatttatag

SEQ ID NO: 1138 - protein, 137 aa, Brugia malayi (Filarial nematode worm)
MLKCSVVLLVLVLVMVCCDDKELARLQIGVKKRVDNCEIRSRKGDTLNVHYVGMLEDGTEFDNSRSRNKPFIFTLGMGQVIKGWDQGLLNMCEGEQRRLATPPDLAYGSSGSPPKIPADASLKFDIELLKIEREGDL

SEQ ID NO: 1139 - DNA, 414 bp, Onchocerca volvulus
  CDS (1)..(414)
atgataaaatttagtgtatccagcttactactggttttggtcgtggttgactgcgacgatagagaattagcgcgtttgcaaataggagtcaagaagcgtgaggacaattgcgagatcagatcaagaaaaggagacatcgtaaatgtgcattatgtgggcatgctagaggacgggaccgaattcgataacatccgattccgcaataaaccatttatattcacactcggcatgggacaagtcattaagggttgggaccagggattactgaacatgtgcgagggcgagcaacgccgtcttgcccttccatctgatttagcatacggcagtttcggttcttcaccgaaaattccttccgatgccagtttgaagttcgatatcgagttgctcaagattgaacgcggaggagatttatag

SEQ ID NO: 1140 - protein, 137 aa, Onchocerca volvulus
MIKFSVSSLLLVLVVVDCDDRELARLQIGVKKREDNCEIRSRKGDIVNVHYVGMLEDGTEFDNIRFRNKPFIFTLGMGQVIKGWDQGLLNMCEGEQRRLALPSDLAYGSFGSSPKIPSDASLKFDIELLKIERGGDL

SEQ ID NO: 1141 - DNA, 327 bp, Caenorhabditis elegans
  CDS (1)..(327)
atgggagtcgacagacagattctcgtcgagggcgacaacgtcaccaagccaaagaacggtcagaccgtcacatgccactacgtgctcacccttgagaacggaaagaagatcgactcttctcgcgaccgcggaactccattcaagttcaagattggaaagggagaggtcatcaagggatgggaccaaggagtcgcccagatgtcagttggtgagaagtcgaagctcaccatctctgccgatcttggctatggaccacgcggagttccaccacaaatcccagccaacgcaactctcgtcttcgaggtcgagcttctcggagtcacctaa

SEQ ID NO: 1142 - protein, 108 aa, Caenorhabditis elegans
MGVDRQILVEGDNVTKPKNGQTVTCHYVLTLENGKKIDSSRDRGTPFKFKIGKGEVIKGWDQGVAQMSVGEKSKLTISADLGYGPRGVPPQIPANATLVFEVELLGVT

SEQ ID NO: 1143 - DNA, 474 bp, Vibrio vulnificus (strain YJ016)
  CDS (1)..(474)
atgtctaaattaatcctacccctgatcattctagtgcttgcggtttttatgatttatcgcacttggaacaatcataaagcagcagaagtgaactttgaaaaaggccaagcattcttgctagaaaacagtaaaaaagaaggtgtgatcaccaccgaaagtggcttgcagtaccaagtattagaaaaaggtcacggcgacaagcatcctagtgcaaacagtaaagttaaagtccattatcatggcatgcttacggatggaactgtattcgacagctctgttgaacgcggttcgccaatgagttttaatctcaaccaagtcatcaaaggctggcaagaaggccttcaatatatggttgaaggtgagaaagtacgcctctttatccctagcactttaggttatggtaaaggcggctctggcccaattccaccagccagtgtgttgatctttgatgttgagttattggaaatccaataa

SEQ ID NO: 1144 - protein, 157 aa, Vibrio vulnificus (strain YJ016)
MSKLILPLIILVLAVFMIYRTWNNHKAAEVNFEKGQAFLLENSKKEGVITTESGLQYQVLEKGHGDKHPSANSKVKVHYHGMLTDGTVFDSSVERGSPMSFNLNQVIKGWQEGLQYMVEGEKVRLFIPSTLGYGKGGSGPIPPASVLIFDVELLEIQ

SEQ ID NO: 1145 - DNA, 486 bp, Gloeobacter violaceus
  CDS (1)..(486)
atgctcaacaaatttactcgcctcaccctcgccaccgccttgctgcttgcggccaccgccgtagcggtgggcgagactgccgttgcccagagccccagccccaccacaggaaaaaataaaatgcctcagccaggccaaactccctcgtacaccaccaccacctccggcctcaagtacctcgacgagaccgtgggcaacggtgcttcgccccagaaaggccagcgcgtcaccgtgcactacaccggcaccctcgaagacggcaagaagttcgactcctcgcgggatcggggccagcccttcagctttaccatcggtgtcggccaggtgattcagggctgggacgagggtgtcgccacgatgaaggtgggcggcaagcgcaaactggtcgtcccggccaacctgggctacggtgcccgcggtgcgggaggggtgatcccgcccaacgccacgctgctgttcgacgtcgaactgttgggcgtgcagtag

SEQ ID NO: 1146 - protein, 161 aa, Gloeobacter violaceus
MLNKFTRLTLATALLLAATAVAVGETAVAQSPSPTTGKNKMPQPGQTPSYTTTTSGLKYLDETVGNGASPQKGQRVTVHYTGTLEDGKKFDSSRDRGQPFSFTIGVGQVIQGWDEGVATMKVGGKRKLVVPANLGYGARGAGGVIPPNATLLFDVELLGVQ

SEQ ID NO: 1147 - DNA, 327 bp, Chromobacterium violaceum
  CDS (1)..(327)
atgagcgaactgatcatcgaagaattgcaggtcggcgaaggcgccgaagccgtcaccggccaggaagtcaccgtccattacaccggctggctgaccgatggcaccaagttcgactccagcaaggaccgcatgcagccgttcagcttcccgctgggcgccggctacgtgatcaagggctgggaccagggcgtgcagggcatgaaggtgggcggcaagcgcaagctgaccatcccgtccgagctgggttacggcgcgcgcggcgcaggcggcgtgattccgccgcacgcgacgctggtgttcgaagtggagctgctgcaggtaggctga

SEQ ID NO: 1148 - protein, 108 aa, Chromobacterium violaceum
MSELIIEELQVGEGAEAVTGQEVTVHYTGWLTDGTKFDSSKDRMQPFSFPLGAGYVIKGWDQGVQGMKVGGKRKLTIPSELGYGARGAGGVIPPHATLVFEVELLQVG

SEQ ID NO: 1149 - DNA, 414 bp, Chromobacterium violaceum
  CDS (1)..(414)
atgttttccacacgaatgatttccgccctggccctgctggcctgcgcgagcggcgcgcaggccgcgaatgccccggcagcgcaaaccctgtcttccggcgtcaagatcgaggtgttggtcgcgggcaagggcgtgaagccctccagcggcgataccgtcaaggtcaattaccgcggcacgttcaaggatggcaaggagttcgacagctcctacaagaatggcggaccgatcagcttcccgctgaatcgcgtgatcccgtgctggacccagggcgtcagcgcgttgacggtcggcagcaaggccaaactgtattgcccggccaataccgcatatggcagccgtggcgtgccgggcgtgattccgcctgatacgccgctgtatttcgaagtggaactgctgtccatccagaagtag

SEQ ID NO: 1150 - protein, 137 aa, Chromobacterium violaceum
MFSTRMISALALLACASGAQAANAPAAQTLSSGVKIEVLVAGKGVKPSSGDTVKVNYRGTFKDGKEFDSSYKNGGPISFPLNRVIPCWTQGVSALTVGSKAKLYCPANTAYGSRGVPGVIPPDTPLYFEVELLSIQK

SEQ ID NO: 1151 - DNA, 342 bp, Chromobacterium violaceum
  CDS (1)..(342)
atgagcgaagaactgaagatcgaggacctggtggtgggcgagggcaaggaggcggtgcgcggcgcgctgatcaccagccattacaccggctggctggaggatggcagcaagttcgactcctcgctggacaagggccggccgttccagtgcgtgatcggcaccggccgcgtgatcaagggctgggaccaggggatgatgggcatgagggtgggcggcaagcgcaggctgtgggtgccggcgcacctggcctacggcgagcgccagatcggcgaccgcattccggccaactccaacctagtgttcgagatcgagttgctggaagtgctgacgcgggatgaataa

SEQ ID NO: 1152 - protein, 113 aa, Chromobacterium violaceum
MSEELKIEDLVVGEGKEAVRGALITSHYTGWLEDGSKFDSSLDKGRPFQCVIGTGRVIKGWDQGMMGMRVGGKRRLWVPAHLAYGERQIGDRIPANSNLVFEIELLEVLTRDE

SEQ ID NO: 1153 - DNA, 327 bp, Anopheles gambiae str. PEST
  CDS (1)..(327)
atgggtgtacagattgtcccaattgccaacggtgaccagaccaccttccccaagccgggtcaaacggcggtcgtccactacaccggcacgctcgacgatggtacggtgttcgattcgtcgcgcacccgcggcaagccgttcaagttctcggtcggcaagggcgaggtgatccgcggctgggacgaaggcgtcgcccagatgtcggtcggccagcgtgccaagctggtgtgctcgccggactacgcctacggtagccgtggccacccgggtgtcatcccaccgaacgctcggttgaccttcgacgtggagctgctgcgagtagaataa

SEQ ID NO: 1154 - protein, 108 aa, Anopheles gambiae str. PEST
MGVQIVPIANGDQTTFPKPGQTAVVHYTGTLDDGTVFDSSRTRGKPFKFSVGKGEVIRGWDEGVAQMSVGQRAKLVCSPDYAYGSRGHPGVIPPNARLTFDVELLRVE

SEQ ID NO: 1155 - DNA, 471 bp, Anopheles gambiae str. PEST
  CDS (1)..(471)
atgaaattcgttttgatcgcgctgctggttgccggcgtcgcctactacttctactcgagcagcaacaacaagaagcaggccgtggaaaacgtgcgcaagggcgccgagttcctcgccgccaacaaggaaaaacccctggtgaccaccaccgcctccggcctgcagtatgaagtgctgaccccgggcaccggcaccgttcaccccaccgccaccagcaaggtgaaggtgcactacgagggcaagctgctggacggcaccgtcttcgacagctcggtcgcccgcggcgagcccatcgagttcggcctcaaccaggtgatcgccggctggaccgaaggggtgcagctgatggtggaaggggagaagacccgcttctacatccccgccaacctggcctacggcgatcgcgccgccggcaagatcccgccgggatccgttttgatcttcgacgtagaactgctgggtattcagtaa

SEQ ID NO: 1156 - protein, 156 aa, Anopheles gambiae str. PEST
MKFVLIALLVAGVAYYFYSSSNNKKQAVENVRKGAEFLAANKEKPLVTTTASGLQYEVLTPGTGTVHPTATSKVKVHYEGKLLDGTVFDSSVARGEPIEFGLNQVIAGWTEGVQLMVEGEKTRFYIPANLAYGDRAAGKIPPGSVLIFDVELLGIQ

SEQ ID NO: 1157 - DNA, 426 bp, Xenopus laevis (African clawed frog)
  CDS (1)..(426)
atgaacctcatgtcatttacacctctgtggtgtttccttatcctattcgtgctgccttctgtctcatccagtgagggcaggaagaaattgcaaattggagtgaagaagcgtgtagaaaattgccctgttaaatcccggaaaggagacacactacacatgcattatacagggaaactggaggatgggacagaatttgacagcagcattcccaggaatcagccgtttaccttcactctgggtaccggacaagtcataaagggctgggaccaagggttacttggaatgtgtgaaggggagaagaggaagctggtaataccttcagaattgggttatggagataggggagcacccccaaaaattccaggaggagccactctgatcttcgaagtggagttattgaagatagaacgtcgatctgaactataa

SEQ ID NO: 1158 - protein, 141 aa, Xenopus laevis (African clawed frog)
MNLMSFTPLWCFLILFVLPSVSSSEGRKKLQIGVKKRVENCPVKSRKGDTLHMHYTGKLEDGTEFDSSIPRNQPFTFTLGTGQVIKGWDQGLLGMCEGEKRKLVIPSELGYGDRGAPPKIPGGATLIFEVELLKIERRSEL

SEQ ID NO: 1159 - DNA, 327 bp, Mus musculus (Mouse)
  CDS (1)..(327)
atgggcgtggagatcgagaccatctccccaggagacggaaggacattccctaagaagggtcagatatgtgtggtgcactacacaggaatgcttcaaaagggcaagaaatttgattcatccagagacagaaacaaacctttcaagttcagaattggcaaacaggaagtcatcaaaggctttgaagaaggcactgcccagatgagcttggggcagagggcgaagctgacctgcacccctgatgtggcctatggagctaccggccaccccggtgtcatccctcccaatgccaccctcatctttgacgtggagctgctcagcttagagtga

SEQ ID NO: 1160 - protein, 108 aa, Mus musculus (Mouse)
MGVEIETISPGDGRTFPKKGQICVVHYTGMLQKGKKFDSSRDRNKPFKFRIGKQEVIKGFEEGTAQMSLGQRAKLTCTPDVAYGATGHPGVIPPNATLIFDVELLSLE

SEQ ID NO: 1161 - DNA, 375 bp, Streptomyces avermitilis
  CDS (1)..(375)
atgagcatcgagaagcccgagatcgacttcccgggcggcgagcccccggcggacctcgagatcaaggacatctgggagggcgacggaccggtcgccaaggcgggcaacaccgtctccgtgcactacgtgggtgtggccttctccaccggcgaggagttcgacgcgtcctggaaccgcggcaccccgctgcagttccagctcggtgccggccaggtcatcaagggctgggaccagggcgtgcagggcatgaaggtcggcggccgccgccagctgaccatcccggcgcacctcgcgtacggcgaccgcggcgccggtggcggccgtatcgcccccggcgagacgctgatcttcgtctgcgacctggtcgcggtctga

SEQ ID NO: 1162 - protein, 124 aa, Streptomyces avermitilis
MSIEKPEIDFPGGEPPADLEIKDIWEGDGPVAKAGNTVSVHYVGVAFSTGEEFDASWNRGTPLQFQLGAGQVIKGWDQGVQGMKVGGRRQLTIPAHLAYGDRGAGGGRIAPGETLIFVCDLVAV

SEQ ID NO: 1163 - DNA, 462 bp, Nitrosomonas europaea
  CDS (1)..(462)
atgatcaacgtaaagaaattactgagtctcgcactttcgggatggctatttctatccatgagcgctcaggctaccgaagaacaggcaacgtcacaccacacaaacgccgctgatgtcactacactggaaaaaatagatacccaggttgggacaggtgaagaggcggatattggcaaaaccgccaaggtgcactatacaggctggctgtatgatgctgctgccgaaggccacaaaggcaggaaattcgacagttcttacgatcgtggaagtcatttttcattcctgctcggagccgggcgggttatcaaagggtgggaccagggtgttatgggtatgaaggtaggtggcaaacgcactctgatcattccctcttccatggcgtatggctcacaaggagccgggcgggtcatccctcccaattcagcactggtattcgatgtggaattggtcggcctggaataa

SEQ ID NO: 1164 - protein, 153 aa, Nitrosomonas europaea
MINVKKLLSLALSGWLFLSMSAQATEEQATSHHTNAADVTTLEKIDTQVGTGEEADIGKTAKVHYTGWLYDAAAEGHKGRKFDSSYDRGSHFSFLLGAGRVIKGWDQGVMGMKVGGKRTLIIPSSMAYGSQGAGRVIPPNSALVFDVELVGLE

SEQ ID NO: 1165 - DNA, 471 bp, Oryza sativa (indica cultivar-group)
  CDS (1)..(471)
atggcagaggttgcagatttaactggggatggaggtgttcttaagacggtggtcagaaaagcaaaggatgatgctatagctccaactgatagtcttcccttggttgatgttcattatgaaggcacactcgctgaaaatggtgaagttttcgacaccactcatgaagacaactctattttctcatttgaaattgggcaaggagctgtcattaaagcatgggatatagctttaagaactatgaaggttggtgaagttgcaaaaataacatgcaagccagaatacgcatacggaagtgcagggtcgccgccagagattccacccaatgcaacactcatttttgaggtggagttagtggcttgtaggcctaggaaaggttcaagcctgggcagtgtttctgatgagaaagccaggctagaggaactaaagaagcagcgagagctagctgctgccaccaaggaggaagagaaataa

SEQ ID NO: 1166 - protein, 156 aa, Oryza sativa (indica cultivar-group)
MAEVADLTGDGGVLKTVVRKAKDDAIAPTDSLPLVDVHYEGTLAENGEVFDTTHEDNSIFSFEIGQGAVIKAWDIALRTMKVGEVAKITCKPEYAYGSAGSPPEIPPNATLIFEVELVACRPRKGSSLGSVSDEKARLEELKKQRELAAATKEEEK

SEQ ID NO: 1167 - DNA, 474 bp, Vibrio parahaemolyticus
  CDS (1)..(474)
atgtctaaatttttgtttcctatcattatttttgttttagctgcatttttcatttaccgcacttggacaaaccacaaagtggcagatgagaactttgcaaaaggccaagctttcctactagaaaatgcgaaaaaagaaggcgtgatcaccacagagagcggacttcaatacctagtactagaaaaaggtacaggtgacgttcacccaaccgcaacaagtaaagtgaaagtgcactaccacggcacgcttatcgatggcactgttttcgatagttcagtaaatcgtggcgagccaattacatttggtttgaaccaagtaattaaaggctggcaagaaggtcttcaatacatggttgtgggcgagaaaatccgtctatttgtaccgagcacacttggctacggcaaaaatggtacggggccaattccacctgcaagtgttttgatttttgatgttgagttgttagagattcagtaa

SEQ ID NO: 1168 - protein, 157 aa, Vibrio parahaemolyticus
MSKFLFPIIIFVLAAFFIYRTWTNHKVADENFAKGQAFLLENAKKEGVITTESGLQYLVLEKGTGDVHPTATSKVKVHYHGTLIDGTVFDSSVNRGEPITFGLNQVIKGWQEGLQYMVVGEKIRLFVPSTLGYGKNGTGPIPPASVLIFDVELLEIQ

SEQ ID NO: 1169 - DNA, 342 bp, Pseudomonas syringae (pv. tomato)
  CDS (1)..(342)
atgagtaaagcactacagattaccgatctgcacatcggtgaaggcaaagcagcggtcaagggtgcgttgatcaccactcattacaccggaaccctggaagacggcacagtgttcgactcttcgcacgagcgcggcaaaccgttccagtgcgtgatcggcaccgggcgcgttatcaaaggctgggatcaaggccttattggcatgaaggtgggcggcaagcgcacactgttcgtccccgcccatctggcctatggcgacaggaccatcggcgcgcacatcaagccgggcgctgaccttaagtttgaaatagagctgcttgaagtgttgacgcgcgatgattga

SEQ ID NO: 1170 - protein, 113 aa, Pseudomonas syringae (pv. tomato)
MSKALQITDLHIGEGKAAVKGALITTHYTGTLEDGTVFDSSHERGKPFQCVIGTGRVIKGWDQGLIGMKVGGKRTLFVPAHLAYGDRTIGAHIKPGADLKFEIELLEVLTRDD

SEQ ID NO: 1171 - DNA, 339 bp, Pseudomonas putida (strain KT2440)
  CDS (1)..(339)
atgagccaagaactgcagatcatcgacctggtcgagggagacggcaaagctgccgtcaaaggtgccctgatcaccacccagtacaccggctggctggccgatggcagcgagttcgactcgtcctggtcgcgcggtaagccgttccagtgcgtgatcggtaccggcagggtaatcaaaggctgggacctaggcctgatgggcatgcgcgttggcggcaagcgcaagctgcaggtaccggcacacctggggtatggcgaacgcagcgtaggggcgatcccgccgaattcggacctgaccttcgagatcgaactgctggaagtgctcacgcgggatgattga

SEQ ID NO: 1172 - protein, 112 aa, Pseudomonas putida (strain KT2440)
MSQELQIIDLVEGDGKAAVKGALITTQYTGWLADGSEFDSSWSRGKPFQCVIGTGRVIKGWDLGLMGMRVGGKRKLQVPAHLGYGERSVGAIPPNSDLTFEIELLEVLTRDD

SEQ ID NO: 1173 - DNA, 465 bp, Bradyrhizobium japonicum
  CDS (1)..(465)
atgcagcgtttccagcgcgtgctcctcgccatcatgtcggcactcgcgatcaccgtgatcgccggcgtgtccgatttcgtttccaccacggcctcggcccagaccgcaggaaagaccatgaccacagcttcaggcttgcaaatcatcgacaccgccgtcggcaccggcgcctcgccgcagcccggccagatctgcgtgatgcactataccggttggctttatgaaaacggccagaagggcaagaaattcgactcctcggtcgatcgcaaggagccgttcgagtttccgatcggcaagggccgcgtgatcgccggctgggacgagggcgtcgcctcgatgaaggtcggtggcaagcgcacgctgatcatcccgccgcagctcggctatggcgcgcgcggcgccggcggcgtgatcccgccgaacgcgacgctgatgttcgacgtggaattgctcgcggtgaagtga

SEQ ID NO: 1174 - protein, 154 aa, Bradyrhizobium japonicum
MQRFQRVLLAIMSALAITVIAGVSDFVSTTASAQTAGKTMTTASGLQIIDTAVGTGASPQPGQICVMHYTGWLYENGQKGKKFDSSVDRKEPFEFPIGKGRVIAGWDEGVASMKVGGKRTLIIPPQLGYGARGAGGVIPPNATLMFDVELLAVK

SEQ ID NO: 1175 - DNA, 402 bp, Bacteroides thetaiotaomicron
  CDS (1)..(402)
atgggaagaaagcaagaatataaagagacgaatttggagttcttgaaagaattgtcatcgcaggaaggtgtttatgccttgccttgcggcatctattataaggttttggagaccggtacggggactgtttttcctaatgtgcggagtattgttaccgttcattataaagggagtctgattaacggtcgggtgttcgataattcttatgaacgtaattgtccggaagctttccgcctctgcgatgtaatagatggttggcaactggcgctccaacggatgcgtgcgggagataaatggatcatctatataccttacacgatgggatacggaacccgtgcatccggtccgattccggctttttcgacattggtatttgaggtagagcttttgggagttgcataa

SEQ ID NO: 1176 - protein, 133 aa, Bacteroides thetaiotaomicron
MGRKQEYKETNLEFLKELSSQEGVYALPCGIYYKVLETGTGTVFPNVRSIVTVHYKGSLINGRVFDNSYERNCPEAFRLCDVIDGWQLALQRMRAGDKWIIYIPYTMGYGTRASGPIPAFSTLVFEVELLGVA

SEQ ID NO: 1177 - DNA, 426 bp, Vibrio vulnificus
  CDS (1)..(426)
atgatttatcgcacttggaacaatcataaagcagcagaagtgaactttgaaaaaggccaagcattcttgctagaaaacagtaaaaaagaaggtgtgataaccaccgaaagtggcctgcagtaccaagtattagaaaaaggtcacggcgacaagcaccctagcgcgagcagtaaagttaaagtccattatcatggcatgcttacggatggaactgtattcgacagctctgttgagcgcggttcgccaatcagttttaatctcaaccaagtcatcaaaggctggcaagaaggccttcaatatatggttgaaggtgagaaagtacgcctctttatccctagcactttaggttatggtaaaggcggctctggcccaattccaccagccagtgtgttgatctttgatgttgagttattggaaattcaataa

SEQ ID NO: 1178 - protein, 141 aa, Vibrio vulnificus
MIYRTWNNHKAAEVNFEKGQAFLLENSKKEGVITTESGLQYQVLEKGHGDKHPSASSKVKVHYHGMLTDGTVFDSSVERGSPISFNLNQVIKGWQEGLQYMVEGEKVRLFIPSTLGYGKGGSGPIPPASVLIFDVELLEIQ

SEQ ID NO: 1179 - DNA, 489 bp, Synechococcus elongatus (Thermosynechococcus elongatus)
  CDS (1)..(489)
atggtaaaacaatgggtgcatcgaggctgcggctggctcctctgtggtattgtcctagtagtggtatggttggtggccgctccgatggcgatcgccagtgtgccactggaggcgtcaacggaggctgcaggactgatggggaatccaaaggtggtgactaccccttcgggtttgcaatacgaagatattgttgtcggctcaggggcacagccccaggtgggcgatcgcgtcacggtgcactacacaggaatgctcactgatggccgtatttttgatagctcccgcgatcgcggtcagcccttccaatttcaaattggtgtcggtcaagtcattaaagggtgggatgaaggggttggctcaatgcacgtcggtggtcagcggcggctgattattcccccgaacctaggctatggtgcccggggggtgggcggggtcattccccccaatgccacgctgatttttgatgttgaactgttgggtgtgcaatag

SEQ ID NO: 1180 - protein, 162 aa, Synechococcus elongatus (Thermosynechococcus elongatus)
MVKQWVHRGCGWLLCGIVLVVVWLVAAPMAIASVPLEASTEAAGLMGNPKVVTTPSGLQYEDIVVGSGAQPQVGDRVTVHYTGMLTDGRIFDSSRDRGQPFQFQIGVGQVIKGWDEGVGSMHVGGQRRLIIPPNLGYGARGVGGVIPPNATLIFDVELLGVQ

SEQ ID NO: 1181 - DNA, 471 bp, Shewanella oneidensis
  CDS (1)..(471)
atgaaaatgttacttgccgttgttgtgattgctggggtgattttttacttctttaccacgatgaacaaccaaaaagcagcgcaggaaaatatccgtttaggtaatgaatttttagcgcaaaacaaaaccaaagaaggtgtggttaccacagcttcaggtttgcaatatcaagtgttaaatcaaggctctggcactattcatcctaaggcgagcgataccgtaactgtgcattaccatggcaccttgatcgacggcaccatattcgatagttccgttgaacgcggtgaccccattgccttcccgctcaatcgggtgattaaaggttggaccgaaggggtgcaattgatggttgaaggcgacaagtatcgcttctttattcccagcgatcttgcctacggcaatcgcagcacgggtaaaattggcggcggctcagtgctgatttttgatgtggaactgttgaagattaattaa

SEQ ID NO: 1182 - protein, 156 aa, Shewanella oneidensis
MKMLLAVVVIAGVIFYFFTTMNNQKAAQENIRLGNEFLAQNKTKEGVVTTASGLQYQVLNQGSGTIHPKASDTVTVHYHGTLIDGTIFDSSVERGDPIAFPLNRVIKGWTEGVQLMVEGDKYRFFIPSDLAYGNRSTGKIGGGSVLIFDVELLKIN

SEQ ID NO: 1183 - DNA, 336 bp, Shewanella oneidensis
  CDS (1)..(336)
atgactgaattagaaataatcgatctggttgtcggtgatggaaaagaagctgtaaaaggcgcgttgatcactacccaataccggggatttttacaggatggtacgcagttcgattcctcctatgaccgtggtcaggcatttcaatgtgtgattgggactggccgagtgattaaaggctgggaccaagggattatggggatgaaagtgggcggcaaacgcaagttattggtgccagctcatttagcctatggtgagcgccaagttggggctcatatcaaaccaaattctgatctcacctttgaaatcgaattgcttgaagtgctgactcgcgactaa

SEQ ID NO: 1184 - protein, 111 aa, Shewanella oneidensis
MTELEIIDLVVGDGKEAVKGALITTQYRGFLQDGTQFDSSYDRGQAFQCVIGTGRVIKGWDQGIMGMKVGGKRKLLVPAHLAYGERQVGAHIKPNSDLTFEIELLEVLTRD

SEQ ID NO: 1185 - DNA, 390 bp, Leptospira interrogans
  CDS (1)..(390)
atgaaatttacacgtttaatatttgtcttagctattctttgtgccgtagtagctcctacatttgcagaagatttagtcattaaagaaattcgtattggaactggaaaagaagctttttcgggttcgaatgttacggttcattatgtaggcacattaacgaacggcaagaagttcgatagttccagagacagaaaaaacccttttaccttcaatttgggagcgggagaggtaatcaaaggttgggacagaggggttcgagggatgaaagaaggtgggattcgtaaacttacaattcctccagaattaggttatggttccagaggggccggagctgcgattcctcctaattctactctcatttttgaagttgaattgttgaaagtgtactga

SEQ ID NO: 1186 - protein, 129 aa, Leptospira interrogans
MKFTRLIFVLAILCAVVAPTFAEDLVIKEIRIGTGKEAFSGSNVTVHYVGTLTNGKKFDSSRDRKNPFTFNLGAGEVIKGWDRGVRGMKEGGIRKLTIPPELGYGSRGAGAAIPPNSTLIFEVELLKVY

SEQ ID NO: 1187 - DNA, 366 bp, Corynebacterium efficiens
  CDS (1)..(366)
atgaaccttatggaaaagccacagattgaagcccagaccggacccgtgccagaggacctggtgatcaaggacctcatcgtgggtgacggtgccgaggcccagccgggcggtgtcgtcgaggtccactacgtcggtgtcgatttcgagaccggtgaggagttcgactcatcctgggaccgtggccagacgaaccagttcccgctcaccggcctgatcgccggttggcaggagggcatcccgggcatgaaggttggcggacgtcgtcagctgaccatccccccggaggctgcctacggcccggagggtagtggacacccactgtccggccgcaccctggtcttcatcatcgacctgatcagcgcctag

SEQ ID NO: 1188 - protein, 121 aa, Corynebacterium efficiens
MNLMEKPQIEAQTGPVPEDLVIKDLIVGDGAEAQPGGVVEVHYVGVDFETGEEFDSSWDRGQTNQFPLTGLIAGWQEGIPGMKVGGRRQLTIPPEAAYGPEGSGHPLSGRTLVFIIDLISA

SEQ ID NO: 1189 - DNA, 408 bp, Bifidobacterium longum
  CDS (1)..(408)
atgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctga

SEQ ID NO: 1190 - protein, 135 aa, Bifidobacterium longum
MTDQMPQVNAEFGTTPVIEFPTPEAPKGLKVVELTEGDGPIVRRGDTVTVNYHGVVWGKDTPFDSSFDRHQPASFGIGVGQVIKGWDQTVPGHNVGSRLVVSIPPEYGYGSRGIPQAGIGGEDTLVFVIDIISTR

SEQ ID NO: 1191 - DNA, 327 bp, Oryctolagus cuniculus (Rabbit)
  CDS (1)..(327)
atgggcgtggagatcgagaccatctcccccggagacgggaggacgtttcccaagaagggccaaacgtgtgtggtgcactacacaggaatgctccaaaatgggaagaaatttgattcatccagagacagaaacaaacctttcaagttccgaattggcaaacaggaagtcatcaaaggtttcgaagaaggtgcagcccagatgagcttggggcagagggcgaagctgacctgcacccctgatgtggcatacggagccacgggccaccccggtgtcatccctcccaatgccaccctcatctttggcgtggagctgctcaacttagagtga

SEQ ID NO: 1192 - protein, 108 aa, Oryctolagus cuniculus (Rabbit)
MGVEIETISPGDGRTFPKKGQTCVVHYTGMLQNGKKFDSSRDRNKPFKFRIGKQEVIKGFEEGAAQMSLGQRAKLTCTPDVAYGATGHPGVIPPNATLIFGVELLNLE

SEQ ID NO: 1193 - DNA, 330 bp, Giardia lamblia (Giardia intestinalis)
  CDS (1)..(330)
atgtcggctcagctggagaagaaggttcttacccctggcgacggcgtcacaaagccccaggcggggaagaaggtcacagttcattacgatggccgttttcccgacggcaagcagtttgactcttcgcgcagccgtgggaaaccctttcaatttactcttggggccggggaggttatcaagggatgggatcaaggtgttgctaccatgactctgggggagaaggctctttttacaattccctaccagcttgcatatggggagcgcggctatccccccgtgattccacctaaggccacgctggtctttgaggtagagcttctcgctgtctag

SEQ ID NO: 1194 - protein, 109 aa, Giardia lamblia (Giardia intestinalis)
MSAQLEKKVLTPGDGVTKPQAGKKVTVHYDGRFPDGKQFDSSRSRGKPFQFTLGAGEVIKGWDQGVATMTLGEKALFTIPYQLAYGERGYPPVIPPKATLVFEVELLAV

SEQ ID NO: 1195 - DNA, 285 bp, Ciona intestinalis
  CDS (1)..(285): k means g or t/U
atgggtattgataaaaaagtcatcaaggaaggaaatggaacatctttccctaaagcaaatcaaacggttaaagktcattatacaggaaccttagaaagtggaaaaaagtttgattcatctcgagatcgtaacaagccatttacatttaaaattggatgtggacaagtaattagaggatgggacgagggggttatccagatgtctgtaggagagagggcaacactaacttgctctcctgattatgcatatggttcgaagggcattggtggtgttattccaacctaa

SEQ ID NO: 1196 - protein, 94 aa, Ciona intestinalis
  misc_feature (25)..(25): Xaa can be Val or Gly
MGIDKKVIKEGNGTSFPKANQTVKXHYTGTLESGKKFDSSRDRNKPFTFKIGCGQVIRGWDEGVIQMSVGERATLTCSPDYAYGSKGIGGVIPT

SEQ ID NO: 1197 - DNA, 330 bp, Tetrahymena thermophila
  CDS (1)..(330)
atgtctgaattataagtagttaccaagaaaccaggtgatggtaagacttatcctaaaaagggataaaccgtcacagtccactacgtcggtaccttcactgatggtagaaagtttgactcttctagagacagaaaggaacctttctaattcaacatcggaagcggttaagttattaaaggttgggatgaaggtgtcgctagaatgtccctcggtgaagttgctgttatcacttgtccttactaatacgcttatggtgaaaagggttatcctggtgtcatccctcctaaggccaccttagttttcgaagttgaactcctcggtatgtaatga

SEQ ID NO: 1198 - protein, 109 aa, Tetrahymena thermophila
MSELQVVTKKPGDGKTYPKKGQTVTVHYVGTFTDGRKFDSSRDRKEPFQFNIGSGQVIKGWDEGVARMSLGEVAVITCPYQYAYGEKGYPGVIPPKATLVFEVELLGMQ

SEQ ID NO: 1199 - DNA, 429 bp, Chlorobium tepidum
  CDS (1)..(429)
atggcacaggccaaaaaaggcgacaaggttctggttcactacaccggcacctatgatgacggcacggttttcgacagctccgtggagcgcgggccgctggaggttaccatcggcaccggcatggtgattcccggcttcgaccgcgcgctgctcgacatggagccgggccagaagaagacggtcaacattcccgttgacgacgcgtatggcccgagagccgaagagcttatcgccgaagttccgcgtgagcggattcctgccgaaattccgcttgaaatcggccagcagttgcaactcagcctcgccgacggcggcgaagtgatcgtgatgatcgtcgatctgaccgacaccaccgtcacgctcgacgccaaccacccgatggctggtctcgacctgaacttcgaacttgaactggtcgaaatcctctga

SEQ ID NO: 1200 - protein, 142 aa, Chlorobium tepidum
MAQAKKGDKVLVHYTGTYDDGTVFDSSVERGPLEVTIGTGMVIPGFDRALLDMEPGQKKTVNIPVDDAYGPRAEELIAEVPRERIPAEIPLEIGQQLQLSLADGGEVIVMIVDLTDTTVTLDANHPMAGLDLNFELELVEIL

SEQ ID NO: 1201 - DNA, 441 bp, Arabidopsis thaliana (Mouse-ear cress)
  CDS (1)..(441)
atgaaagctgttggatttttgcttctgcttaccattctaacattagcttatgcgaagaagtcaggtgatgtgacagagttgcagattggtgttaagtacaagcctcagaaatgtgatctccaggctcacaaaggggataagatcaaggttcactatcggggaaagttaactgatggaactgtctttgattcaatttttgagagaggtgaccctattgagtttgagcttggaactggtcaagtcatcccaggatgggaccagggtttattgggagcttgtgtaggtgagaagagaaagttgaaaatcccatccaagcttggttatggtgataacggctcaccaccaaaaatcccgggtggggcgacactgatattcgacaccgagcttgttgctgtgaacggagaaccatccagcgaagcgaaatcaaagaatgagctttga

SEQ ID NO: 1202 - protein, 146 aa, Arabidopsis thaliana (Mouse-ear cress)
MKAVGFLLLLTILTLAYAKKSGDVTELQIGVKYKPQKCDLQAHKGDKIKVHYRGKLTDGTVFDSIFERGDPIEFELGTGQVIPGWDQGLLGACVGEKRKLKIPSKLGYGDNGSPPKIPGGATLIFDTELVAVNGEPSSEAKSKNEL

SEQ ID NO: 1203 - DNA, 339 bp, Arabidopsis thaliana (Mouse-ear cress)
  CDS (1)..(339)
atgggtgtggagaagcaagtcatcagacccggcaacggtccaaaacccgctccgggccaaaccgtcaccgtccattgcaccggattcgggaaagatggtgatctatcccagaagttctggagtacaaaggacgagggacaaaaacctttctcgttccaaatcggtaaaggtgctgtgatcaaaggatgggatgaaggcgttatcggaatgcaaattggagaggttgctcgcttgcggtgctcatcggattacgcatatggcgctggtggatttccggcatgggggatccagccaaactctgttctcgactttgaaatcgaagtactgagcttgcagtaa

SEQ ID NO: 1204 - protein, 112 aa, Arabidopsis thaliana (Mouse-ear cress)
MGVEKQVIRPGNGPKPAPGQTVTVHCTGFGKDGDLSQKFWSTKDEGQKPFSFQIGKGAVIKGWDEGVIGMQIGEVARLRCSSDYAYGAGGFPAWGIQPNSVLDFEIEVLSLQ

SEQ ID NO: 1205 - DNA, 432 bp, Oryza sativa (japonica cultivar-group)
  CDS (1)..(432)
atgtttggcttatacatcgtttgctcgatttggctttcagcttcggccaagaagtccggagatgtcacggagcttcagatcggtgtgaagtacaagccagagtcatgcaccctgcaagctcacaaaggagacaaaatcaaagtgcattatcgtgggtcactcactgatggatcagtgtttgattctagctatgacagaggtgacccctttgaatttactcttggaaacggccaagtgataaaaggttgggaccaagggttactaggtatgtgtgtcggtgaaaagaggaagctaaagatacctgcaaagatgggttatggggagagaggctccccaccgaagattccaggtggagcaacactaatctttgacacggagcttatcgccgtcaatggaaagacaaccggtggtgctagcaatagtgagctctaa

SEQ ID NO: 1206 - protein, 143 aa, Oryza sativa (japonica cultivar-group)
MFGLYIVCSIWLSASAKKSGDVTELQIGVKYKPESCTLQAHKGDKIKVHYRGSLTDGSVFDSSYDRGDPFEFTLGNGQVIKGWDQGLLGMCVGEKRKLKIPAKMGYGERGSPPKIPGGATLIFDTELIAVNGKTTGGASNSEL

SEQ ID NO: 1207 - DNA, 327 bp, Schistosoma mansoni (Blood fluke)
  CDS (1)..(327)
atgggcgttaccgttgatacctacaagccaggggatggtaaacgaattccaaagaaaggtcagagagtcgttgttcattacactggtactctcatggatgggaaaaagtttgatagttcacgtgacagaaataaaccattcgagtttgtaattgggacggggaaagtaattcgaggttgggatgaaggtgttattcaaatgagtgtgggagagcgtgcctaccttacttgtactccagactacgcatatggttccaagggggtcgataaagttatccctccaaatgctactctgaaatttgatgtggagttaatcgatatattatga

SEQ ID NO: 1208 - protein, 108 aa, Schistosoma mansoni (Blood fluke)
MGVTVDTYKPGDGKRIPKKGQRVVVHYTGTLMDGKKFDSSRDRNKPFEFVIGTGKVIRGWDEGVIQMSVGERAYLTCTPDYAYGSKGVDKVIPPNATLKFDVELIDIL

SEQ ID NO: 1209 - DNA, 399 bp, Xanthomonas campestris (pv. campestris)
  CDS (1)..(399)
atgctggcgagctgcgcccctgccctgcccccgtccggtggcaccatcgccgcgttcgagcggatcgatcgcaccgtcggcactggcgccgaagccacgcccaatgcgcttgtcaccgtgcactacaccggctggctatacgacgagaaggcggccgacaaacacggcaagaagttcgacagctcgctggatcgcgccgagccgttccagttcgtgctcggtggccgccaggtcatacgcggctgggatgagggtgtggccggcatgcgcgtcggcggcaagcggaccttgatgatcccgccggagttcggttacggcgacaaaggtgccggtggggtcattccgccgggcgcctcgctggtgttcgacgtcgaactgcttggcgtgcagccgcgctga

SEQ ID NO: 1210 - protein, 132 aa, Xanthomonas campestris (pv. campestris)
MLASCAPALPPSGGTIAAFERIDRTVGTGAEATPNALVTVHYTGWLYDEKAADKHGKKFDSSLDRAEPFQFVLGGRQVIRGWDEGVAGMRVGGKRTLMIPPEFGYGDKGAGGVIPPGASLVFDVELLGVQPR

SEQ ID NO: 1211 - DNA, 399 bp, Xanthomonas axonopodis (pv. citri)
  CDS (1)..(399)
atgctcgcaagctgcgcacccaccctgccgccctccggcgggaccatcgccagtttcgagcggatcgaccgcaacctggggaccggcgcagaggccacaccaggggccatggtcaccgtgcactacaccggctggctgtacgacgaaaaagccgccgacaaacatggcaagaagttcgacagctcgctggatcgcgccgagccgttccaattcgtattgggcggccaccaggtcatccgcggctgggacgatggcgtggccggcatgcgtgtcggcggcaagcgcaccttgatgatcccgcccgattacggctatggcgacaacggcgccggtggcgtgataccgcccggtgcatcgctggtgttcgatgtggaattgctgggcgtgcagccgcgttga

SEQ ID NO: 1212 - protein, 132 aa, Xanthomonas axonopodis (pv. citri)
MLASCAPTLPPSGGTIASFERIDRNLGTGAEATPGAMVTVHYTGWLYDEKAADKHGKKFDSSLDRAEPFQFVLGGHQVIRGWDDGVAGMRVGGKRTLMIPPDYGYGDNGAGGVIPPGASLVFDVELLGVQPR

SEQ ID NO: 1213 - DNA, 501 bp, Drosophila melanogaster (Fruit fly)
  CDS (1)..(501)
atgggcgtacaagtagttccaattgctcctggtgatggcagcacctatcccaagaatggccaaaaggtcacggtccactacaccggcaccctggacgatggcaccaagttcgattcgtcgcgcgaccgcaacaagccattcaagttcaccatcggcaagggcgaggtcatccgtggctgggatgagggagttgcccagttgagcgtcggccagcgcgccaagctgatttgctcgccggactatgcctacggtagccgtggccaccccggcgtcattccgcccaactccaccctcaccttcgacgtcgagctgctcaaggtcgataggcgcacaggatgcccaatgtgtataccccaaaccaaatcgcagggggttgcggaccggcgcaccggcgacgagccgaagaacatcataatcggaaccagaacaatccagcagcatttgccaacccaaaataataatgataacttcatacacagctctaaactagaactaatttaa

SEQ ID NO: 1214 - protein, 166 aa, Drosophila melanogaster (Fruit fly)
MGVQVVPIAPGDGSTYPKNGQKVTVHYTGTLDDGTKFDSSRDRNKPFKFTIGKGEVIRGWDEGVAQLSVGQRAKLICSPDYAYGSRGHPGVIPPNSTLTFDVELLKVDRRTGCPMCIPQTKSQGVADRRTGDEPKNIIIGTRTIQQHLPTQNNNDNFIHSSKLELI

SEQ ID NO: 1215 - DNA, 504 bp, Pyrus communis (Pear)
  CDS (1)..(504)
atgattgggttgcttttcggagtttcaagcgctgtgacaggcgcatttgaagctgagggagctggtctgcccccagaagagaagcctcgactgtgtgataattcttgcgagaaggagttattgaaggtgcctatggtaactacagagtctggtttgcagtacaaggatattaaagttggtcaaggccccagtccaccagtcggttttcaggtagcagcgaattatgtagccatggttccatctggacaaatatttgacagttcattggagaagggtcaagtttatatatttcgtgttggctctggtcaggtgatcaagggacttgatgaagggatcttgtccatgaaagtaggagggaagcgacgactctacatcccaggatcgttggcatttcccaagggtctcaattcagctccgggaagaccaagggtggctccaagcagtccggttgttttcgatgtgagcttggaatacgtaccaggccttgacattgaggaagagtaa

SEQ ID NO: 1216 - protein, 167 aa, Pyrus communis (Pear)
MIGLLFGVSSAVTGAFEAEGAGLPPEEKPRLCDNSCEKELLKVPMVTTESGLQYKDIKVGQGPSPPVGFQVAANYVAMVPSGQIFDSSLEKGQVYIFRVGSGQVIKGLDEGILSMKVGGKRRLYIPGSLAFPKGLNSAPGRPRVAPSSPVVFDVSLEYVPGLDIEEE

SEQ ID NO: 1217 - DNA, 426 bp, Ralstonia solanacearum (Pseudomonas solanacearum)
  CDS (1)..(426)
atgaaacgcctttccctgctgctgtgcgccacgtcgctcgccctcgctgcatacaacgttcaggcggcatccgccgtgtcggccgcgccggccgagtcgctgccgtcgggcgtgaccatccagcatgtggccaagggtagcgggccgtcgcccaaggcgaccgatacggtcaaggtgcactatcgcggcacgctggccgacggcaccgagttcgacagctcctacaagcgcggccagccgatctccttcccgctgaatcgcgtgatcccgtgctggaccgagggcgtgcagaagatgcaggtggggggcaaggccaagctgacgtgtccgccggcgaccgcctacggtgcgcgcggtgtgcccggcacgattccgcccaacgccacgctgaacttcgaggtcgagctgctcggcatcggcggctga

SEQ ID NO: 1218 - protein, 141 aa, Ralstonia solanacearum (Pseudomonas solanacearum)
MKRLSLLLCATSLALAAYNVQAASAVSAAPAESLPSGVTIQHVAKGSGPSPKATDTVKVHYRGTLADGTEFDSSYKRGQPISFPLNRVIPCWTEGVQKMQVGGKAKLTCPPATAYGARGVPGTIPPNATLNFEVELLGIGG

SEQ ID NO: 1219 - DNA, 354 bp, Ralstonia solanacearum (Pseudomonas solanacearum)
  CDS (1)..(354)
atgaccatcaccaccacccagagcggcctgcaatacgaagacgtcaccgtgggcgacggcgccgaagccaccgccggcaagtacgtcaccgtgcactacaccggctggctgtacgagaacggccaggccggccgcaagttcgattccagcaaggaccgcaacgatccgttcgccttcccgctgggcgccggccacgtcatcaagggctgggacgaaggcgtgcagggcatgaaggtcggcggcacgcgcaagctgatcatcccggccgagctgggctacggtgcgcgcggcgcgggtggggtgattcccccgaacgcaacgctgcttttcgaggtcgatctgctggaagtctga

SEQ ID NO: 1220 - protein, 117 aa, Ralstonia solanacearum (Pseudomonas solanacearum)
MTITTTQSGLQYEDVTVGDGAEATAGKYVTVHYTGWLYENGQAGRKFDSSKDRNDPFAFPLGAGHVIKGWDEGVQGMKVGGTRKLIIPAELGYGARGAGGVIPPNATLLFEVDLLEV

SEQ ID NO: 1221 - DNA, 327 bp, Gallus gallus (Chicken)
  CDS (1)..(327)
atgggcgtgcacgtggagaccatcgcccccggcgacgggcggacgttccccaaacgcggccagacgtgcgtggtgcattacacgggtatgctggaggatgggaagaagttcgattcctcccgcgacaggaacaaacccttcaagttcgtgatgggcaaacaggaggtgatccgcggctgggaggaaggagttgctcagatgagcgtcggtcagagggcgaagatgaccatctccccagattatgcctatggctccactggccacccagggatcatcccaccaaacgccactctaatcttcgacgtggagctcatgaaattggaatga

SEQ ID NO: 1222 - protein, 108 aa, Gallus gallus (Chicken)
MGVHVETIAPGDGRTFPKRGQTCVVHYTGMLEDGKKFDSSRDRNKPFKFVMGKQEVIRGWEEGVAQMSVGQRAKMTISPDYAYGSTGHPGIIPPNATLIFDVELMKLE

SEQ ID NO: 1223 - DNA, 372 bp, Streptomyces coelicolor
  CDS (1)..(372)
atgagcatcgacaagcccgaggtcgacttcccgggcggcgagcccccggcggacctcgagatcaaggacatctgggagggcgacggcccggttgccgaggccggtcagaccgtgaccgtccactacgtgggcgtgaccttcagcacgggcgaggagttcgacgccagctggaaccgcggtgcgccgttccgcttcccgctcggcggcggccgcgtcatcaagggctgggaccagggcgtgcagggcatgaaggtcggcggccgtcgccagctgaccatcccggcgcacctcgcctacggcgaccagagcccggccccggcgatcccgcccggctcgacgctgatcttcgtggtcgatctgctcggagtctga

SEQ ID NO: 1224 - protein, 123 aa, Streptomyces coelicolor
MSIDKPEVDFPGGEPPADLEIKDIWEGDGPVAEAGQTVTVHYVGVTFSTGEEFDASWNRGAPFRFPLGGGRVIKGWDQGVQGMKVGGRRQLTIPAHLAYGDQSPAPAIPPGSTLIFVVDLLGV

SEQ ID NO: 1225 - DNA, 369 bp, Mycobacterium smegmatis
  CDS (1)..(369)
atgaccagcaccgaaaagcccgaggtcgagttccaggcgggtccgccgccgtccgagctgaccatgaccgacctgatcgtcggtgagggcgccgaagccgtgcgcggcggcgtcgtcgacgtccactacgtgggtgtcgactacgagaccggcgaggagttcgactcatcgtgggatcgtggccagtcggccaacttcccgctcgaccggctgatccccggctggcaggaaggcatccccggcatgaaggtcggcggccgccgccagctcacggttccgccggagctggcctacgggcccgccggcgcgggccaccggctgtcgggacgcaccctcgtgttcgtcatcgacctgctcggggtggcctga

SEQ ID NO: 1226 - protein, 122 aa, Mycobacterium smegmatis
MTSTEKPEVEFQAGPPPSELTMTDLIVGEGAEAVRGGVVDVHYVGVDYETGEEFDSSWDRGQSANFPLDRLIPGWQEGIPGMKVGGRRQLTVPPELAYGPAGAGHRLSGRTLVFVIDLLGVA

SEQ ID NO: 1227 - DNA, 327 bp, Manduca sexta (Tobacco hawkmoth) (Tobacco hornworm)
  CDS (1)..(327)
atgggcgtgaccgtagacactattaccccaggagatgagtccacataccccaagaatggacagaccgtagtagtgcactacacgggcacactcaccagcgggaagaagttcgattcctcgcgcgaccgcggcaagcccttcaagttcaggattggcaagggagaggtgatccgaggctgggacgagggtgttgctaagatgtcagtaggagagcgcgccaagctgacttgcacccccgactacgcctacggccagcaggggcacccgggcgtcatcccacccaactcgaccctcatcttcgacgtggaactcttgcgtctcgaataa

SEQ ID NO: 1228 - protein, 108 aa, Manduca sexta (Tobacco hawkmoth) (Tobacco hornworm)
MGVTVDTITPGDESTYPKNGQTVVVHYTGTLTSGKKFDSSRDRGKPFKFRIGKGEVIRGWDEGVAKMSVGERAKLTCTPDYAYGQQGHPGVIPPNSTLIFDVELLRLE

SEQ ID NO: 1229 - DNA, 327 bp, Brugia malayi (Filarial nematode worm)
  CDS (1)..(327)
atgccggtgaaaatcgataccaacaaagaaggggacggtcaaacattcccgaaaacgggacaaactgtaacctgtcactatgtattgacgttagaaaatggtgaagaggtagacagttcacgttcacgtggcaagccattcaaattcaagatcggcgcaggtgaagtcatcaaaggatgggatcaaggtgttgcaaagatgtctgttggccaacgtgcgaagttgacggtttcatcagatcttggttatggtagccgaggaattccaggcgctataccaccaaattcaactttgatttttgatgttgaacttcttggtgtggaataa

SEQ ID NO: 1230 - protein, 108 aa, Brugia malayi (Filarial nematode worm)
MPVKIDTNKEGDGQTFPKTGQTVTCHYVLTLENGEEVDSSRSRGKPFKFKIGAGEVIKGWDQGVAKMSVGQRAKLTVSSDLGYGSRGIPGAIPPNSTLIFDVELLGVE

SEQ ID NO: 1231 - DNA, 327 bp, Drosophila melanogaster (Fruit fly)
  CDS (1)..(327)
atgggcgtacaagtagttccaattgctcctggtgatggcagcacctatcccaagaatggccaaaaggtcacggtccactacaccggcaccctggacgatggcaccaagttcgattcgtcgcgcgaccgcaacaagccattcaagttcaccatcggcaagggcgaggtcatccgtggctgggatgagggagttgcccagttgagcgtcggccagcgcgccaagctgatttgctcgccggactatgcctacggtagccgtggccaccccggcgtcattccgcccaactccaccctcaccttcgacgtcgagctgctcaaggtcgaatag

SEQ ID NO: 1232 - protein, 108 aa, Drosophila melanogaster (Fruit fly)
MGVQVVPIAPGDGSTYPKNGQKVTVHYTGTLDDGTKFDSSRDRNKPFKFTIGKGEVIRGWDEGVAQLSVGQRAKLICSPDYAYGSRGHPGVIPPNSTLTFDVELLKVE

SEQ ID NO: 1233 - DNA, 417 bp, Drosophila melanogaster (Fruit fly)
  CDS (1)..(417)
atgaagttaacttatattttgttaatctgcgcttttgtggccgcctccgctgccagcgatccgaaagtgaagattggcattaagaagcgggtggagaactgcacccggaaggccaagggcggcgatctcgtccacgtgcactacagaggagcactgcaggatggaacagagttcgatagcagctactcccgcggcactcccttctcctttaccctgggagctcggcaggtgatcaagggctgggatcagggaatccttggtatgtgtgagggtgagcagcgaaagctgacgattccgcctgagctgggatacggagccagtggagcgggtggcggaaagattccccccaatgcggtgctcgtcttcgatacggagttggtaaaaatcgaaccgcgctctggatctgaagagctgtaa

SEQ ID NO: 1234 - protein, 138 aa, Drosophila melanogaster (Fruit fly)
MKLTYILLICAFVAASAASDPKVKIGIKKRVENCTRKAKGGDLVHVHYRGALQDGTEFDSSYSRGTPFSFTLGARQVIKGWDQGILGMCEGEQRKLTIPPELGYGASGAGGGKIPPNAVLVFDTELVKIEPRSGSEEL

SEQ ID NO: 1235 - DNA, 462 bp, Arabidopsis thaliana (Mouse-ear cress)
  CDS (1)..(462)
atgatgagctctgcatccgccatgaaagctgttggatttttgcttctgcttaccattctaacattagcttatgcgaagaagtcaggtgatgtgacagagttgcagattggtgttaagtacaagcctcagaaatgtgatctccaggctcacaaaggggataagatcaaggttcactatcggggaaagttaactgatggaactgtctttgattcaagttttgagagaggtgaccctattgagtttgagcttggaactggtcaagtcatcccaggatgggaccagggtttattgggagcttgtgtaggtgagaagagaaagttgaaaatcccatccaagcttggttatggtgataacggctcaccaccaaaaatcccgggtggggcgacactgatattcgacaccgagcttgttgctgtgaacggagaaccatccagcgaagcgaaatcaaagaatgagctttga

SEQ ID NO: 1236 - protein, 153 aa, Arabidopsis thaliana (Mouse-ear cress)
MMSSASAMKAVGFLLLLTILTLAYAKKSGDVTELQIGVKYKPQKCDLQAHKGDKIKVHYRGKLTDGTVFDSSFERGDPIEFELGTGQVIPGWDQGLLGACVGEKRKLKIPSKLGYGDNGSPPKIPGGATLIFDTELVAVNGEPSSEAKSKNEL

SEQ ID NO: 1237 - DNA, 492 bp, Arabidopsis thaliana (Mouse-ear cress)
  CDS (1)..(492)
atggcgagcaagatgagtctccgttactctctctttttgatcttcttctctctcatttcactccaaggttttgccaagaagaccggagatgtgtcggaattgcagatcggtgtcaagtttaagccaaaaacatgtgaagttcaggctcacaaaggtgatacgatcaaggtgcactatagggggaaacttactgatggaactgtattcgattcgagttttgaaaggggtgatccgtttgagtttaaattaggaagtggtcaggttatcaaaggttgggatcaaggtttgctaggagcgtgtgtaggtgagaagaggaagttaaagatacctgctaaacttggatatggagaacaaggctctccacctactatccccggtggtgcaacactgatctttgacacagagcttattgcggtaaatgaaaaaccagctggtggtgaagaatacggaggggatgaagatgatgagggatatggaaatgacgagctatga

SEQ ID NO: 1238 - protein, 163 aa, Arabidopsis thaliana (Mouse-ear cress)
MASKMSLRYSLFLIFFSLISLQGFAKKTGDVSELQIGVKFKPKTCEVQAHKGDTIKVHYRGKLTDGTVFDSSFERGDPFEFKLGSGQVIKGWDQGLLGACVGEKRKLKIPAKLGYGEQGSPPTIPGGATLIFDTELIAVNEKPAGGEEYGGDEDDEGYGNDEL

SEQ ID NO: 1239 - DNA, 327 bp, Xenopus laevis (African clawed frog)
  CDS (1)..(327)
atgggagtgcaagtagaaaccattaccgagggggacgggcgcacgtttccaaagaagggccagactgtggtggtacattatgtggggtcgctggagaacggaaagaagtttgattcgtcaagggacaggaacaagcctttcaagttcataattggacggtgcgaagtgatccgtggctgggaggagggcgtggcacagatgagtgtggggcagagggcacgactcacctgctctcctgactttgcatacggggcaacaggacaccctggcattattccccccaacgccaccctgacctttgatgtggagctactgaggctggagtga

SEQ ID NO: 1240 - protein, 108 aa, Xenopus laevis (African clawed frog)
MGVQVETITEGDGRTFPKKGQTVVVHYVGSLENGKKFDSSRDRNKPFKFIIGRCEVIRGWEEGVAQMSVGQRARLTCSPDFAYGATGHPGIIPPNATLTFDVELLRLE

SEQ ID NO: 1241 - DNA, 375 bp, Candida albicans (Yeast)
  CDS (1)..(375)
atgtctgaagaacttccacaaattgaaattgttcaagaaggtgataacaccacatttgctaagccaggtgatacagtaaccattcattatgatggtaaattaactaatggtaaagaatttgattcatcaagaaaaagaggtaaaccatttacttgtactgttggtgttggtcaagttattaaaggttgggatatttctttaactaacaattatggtaaaggtggtgctaatttacctaaaatttcaaagggaactaaagcaattttaactattggaccaaatttggcttatggtccaagaggtatcccaccaattattggtcctaatgaaactcttgttttcgaagttgaattacttggtgttaatggtcaataa

SEQ ID NO: 1242 - protein, 124 aa, Candida albicans (Yeast)
MSEELPQIEIVQEGDNTTFAKPGDTVTIHYDGKLTNGKEFDSSRKRGKPFTCTVGVGQVIKGWDISLTNNYGKGGANLPKISKGTKAILTIGPNLAYGPRGIPPIIGPNETLVFEVELLGVNGQ

SEQ ID NO: 1243 - DNA, 375 bp, Streptomyces chrysomallus
  CDS (1)..(375)
atgagcatcgagaagcccgaggtcgacttcccgggtggcgagccgccggccgacctggcgatcaaggacatctgggagggcgacggcccggtggcccaggccggccagaccgtctccgtccactacgtgggcgtggccttctccaccggcgaggagttcgacgcctcctggaaccgcggcaccccgctgcagttccagctcggtgccggtcaggtcatctccggctgggaccagggcgtgcagggcatgaaggtcggcggtcgccgtgagctgatcatccccgcgcacctcgcctacggcgaccgcggcgccggcggcggcaagatcgccccgggcgagacgctgatcttcgtctgcgacctcgtcgcggtctga

SEQ ID NO: 1244 - protein, 124 aa, Streptomyces chrysomallus
MSIEKPEVDFPGGEPPADLAIKDIWEGDGPVAQAGQTVSVHYVGVAFSTGEEFDASWNRGTPLQFQLGAGQVISGWDQGVQGMKVGGRRELIIPAHLAYGDRGAGGGKIAPGETLIFVCDLVAV

SEQ ID NO: 1245 - DNA, 327 bp, Brachydanio rerio (Zebrafish) (Danio rerio)
  CDS (1)..(327)
atgggagtcgaggttgaaaccattactcctggagacggaagtaccttccctaaaaaaggacagacttgcgtcgtgcattatgtgggctctttgacagatggacgcaaattcgactcttcccgggatcggggaaagcctttcaagtttaaaatcggcaaacaggaagtgatccgcggctgggatgagggagtagcccagatgagtgtcggacagcgcgccaagctgacttgcactccggactttgcttacgggagcaagggccacccgggcgtcattcctcccaacgcaacgctcatattcgacgtggagctgattggcttggaataa

SEQ ID NO: 1246 - protein, 108 aa, Brachydanio rerio (Zebrafish) (Danio rerio)
MGVEVETITPGDGSTFPKKGQTCVVHYVGSLTDGRKFDSSRDRGKPFKFKIGKQEVIRGWDEGVAQMSVGQRAKLTCTPDFAYGSKGHPGVIPPNATLIFDVELIGLE

SEQ ID NO: 1247 - DNA, 327 bp, Brachydanio rerio (Zebrafish) (Danio rerio)
  CDS (1)..(327)
atgggtgttgaggttgaaacaatatctccaggagacggaagaacctttccgaagaaaggacagacatgcgttgtgcattacatagggatgctgcagaatggaaagaagtttgactcgtcacgagacagaaacaagccattcaagtttaagatcggccgacaagaagtcatcaagggctgggaggaaggagtcgcacaaatgagtttgggtcagcgggcgaagatcacctgcaccccagatatggcgtacggggccacaggacaccctggtgtcattcctcccaatgccacgcttatatttgacgtagagctgctgaaattggagtga

SEQ ID NO: 1248 - protein, 108 aa, Brachydanio rerio (Zebrafish) (Danio rerio)
MGVEVETISPGDGRTFPKKGQTCVVHYIGMLQNGKKFDSSRDRNKPFKFKIGRQEVIKGWEEGVAQMSLGQRAKITCTPDMAYGATGHPGVIPPNATLIFDVELLKLE

SEQ ID NO: 1249 - DNA, 327 bp, Xenopus laevis (African clawed frog)
  CDS (1)..(327)
atgggagtggatctggaaactatctcacctggagacggtaggacatttccaaagaagggccaaacatgtgtagtccattacacagggatgttaacgagtggaaagacgtttgactcgtccagagaccggaacaagcctttcaagttcaagattgggaggcaggaagtgatcaaaggctgggaggaaggagttgcacagatgagtgtgggccagagagcaaagctaacctgctcccctgatgttgcctatggagccacagggcaccccggagtcattcctcccaatgccgttctgatcttcgatgttgagttaatacggatagagtag

SEQ ID NO: 1250 - protein, 108 aa, Xenopus laevis (African clawed frog)
MGVDLETISPGDGRTFPKKGQTCVVHYTGMLTSGKTFDSSRDRNKPFKFKIGRQEVIKGWEEGVAQMSVGQRAKLTCSPDVAYGATGHPGVIPPNAVLIFDVELIRIE

SEQ ID NO: 1251 - DNA, 465 bp, Gamma-proteobacterium EBAC31A08
  CDS (1)..(465)
atgaaaaataaattagtccaaatatttcttcttctttttatagttgcgtgtaatcaggatagccctaatattaaacaaattagtaatatgcagtattttattgataatgaaataagggaaggaatctattctgttgaaccaggcttgcaatactcaattatccaaaatggagatcaaagttctgaatcaccattgctgcaggatacaattacagctcattttcacgggaccctcactgatggctcagttttttggagttctgttgaaatgggtgagcccttaacagtcgaactatcaggtctaatagttgggtgccaaaaaataatctctatgatgaagaaaggtgatgaatggagagtttatatcgacccaagtatggcctatggcgatgagggccggcctgggataccttcaaactcaattcttatttttgatattgagttattagatatccaaaaaaactaa

SEQ ID NO: 1252 - protein, 154 aa, Gamma-proteobacterium EBAC31A08
MKNKLVQIFLLLFIVACNQDSPNIKQISNMQYFIDNEIREGIYSVEPGLQYSIIQNGDQSSESPLLQDTITAHFHGTLTDGSVFWSSVEMGEPLTVELSGLIVGCQKIISMMKKGDEWRVYIDPSMAYGDEGRPGIPSNSILIFDIELLDIQKN

SEQ ID NO: 1253 - DNA, 492 bp, Streptomyces rishiriensis
  CDS (1)..(492)
atgtgtccggctggtccgacggcttccgacggaagtgatgaggctgtgatgagtgaaccgacaaagcccgaggtcgacgttccagagggcgacgcgcctaccgagctgaccatccgggacctgatcgtcggtgacggggtcgaggtcaagccgggcatggtggtcagggtccactatgtcggggtgactttcgagtccgggaaggagttcgatgcctcctgggatcggggccagccgttcaagttcgccgtgggcagtggcaaggtcatcaagggctgggaccgaggggtgagagggatgaacgtcggcggtcggcgcgagatcatcgttcctccgcgtcttggatacggcaatcagtcgccttcgccgttgatcccgccgagctcgaccctggtcttcgtggtggacctgctggacgcgtattccagcgcaaccgggtggagcaacgcccagcgggggcacggagtcatcccagggcgggcggaaccctag

SEQ ID NO: 1254 - protein, 163 aa, Streptomyces rishiriensis
MCPAGPTASDGSDEAVMSEPTKPEVDVPEGDAPTELTIRDLIVGDGVEVKPGMVVRVHYVGVTFESGKEFDASWDRGQPFKFAVGSGKVIKGWDRGVRGMNVGGRREIIVPPRLGYGNQSPSPLIPPSSTLVFVVDLLDAYSSATGWSNAQRGHGVIPGRAEP

SEQ ID NO: 1255 - DNA, 417 bp, Geobacter sulfurreducens
  CDS (1)..(417)
atggcggcctgttcggacagggaaaccaagccggccggcgaggcgaagcctgcaagcgccgccggcgcctcggatgccgtcacgactgcttcggggctttcctacgtggaccttgccgccgggtccggtgcggcccccgtggccggtaaaccggtgaaggttcactacacgggctggcttgagaacggcacgaagttcgacagctccgtggaccggggagagccgttcgtcttcaccatcggcgcgggcgaggtgatcccgggatgggacgagggggtcatgtccatgaaggtcggcggcaagcgccgtctcatcgtacccccccaactcgggtacggtgccgccggagccggcggggtgatcccgccgaatgcaactctgattttcgaggtggaactgctcgacgttgccacgtga

SEQ ID NO: 1256 - protein, 138 aa, Geobacter sulfurreducens
MAACSDRETKPAGEAKPASAAGASDAVTTASGLSYVDLAAGSGAAPVAGKPVKVHYTGWLENGTKFDSSVDRGEPFVFTIGAGEVIPGWDEGVMSMKVGGKRRLIVPPQLGYGAAGAGGVIPPNATLIFEVELLDVAT

SEQ ID NO: 1257 - DNA, 435 bp, Geobacter sulfurreducens
  CDS (1)..(435)
atgagaacagctcaatcgggcgacatcgtcttcattcactacatcggtaccctggacaacggcagaatcttcgacagcaccaccgacgaggcgccactgcgcttcaccattggcaaaaacgaaatctttcccgccctggagcgccaaatcatcggcatgcggccgggcgaggccaggaacatcctgatcgccgccgcagacgcctatggtccgcgccgggcggaaaacatgctgaccctggggcgggactccttccccgcggaccgtcccatctcggttggtcagaaactgcgccttgagttcaacggcagcgccgagcgggtcatgcttgtggtggaggtgaccgacgcccatgtggttctggatggtaatcatcccctggccggttgcgacctgacctttgcgctccggctcgacggaatcgaaaacgcctga

SEQ ID NO: 1258 - protein, 144 aa, Geobacter sulfurreducens
MRTAQSGDIVFIHYIGTLDNGRIFDSTTDEAPLRFTIGKNEIFPALERQIIGMRPGEARNILIAAADAYGPRRAENMLTLGRDSFPADRPISVGQKLRLEFNGSAERVMLVVEVTDAHVVLDGNHPLAGCDLTFALRLDGIENA

SEQ ID NO: 1259 - DNA, 339 bp, Malassezia pachydermatis
  CDS (1)..(339)
atgggtgtgactgtggaatcgatctcgaacggcgacggcaagaccttccctaaggccggtgacactgtagacatgcactacgtgggtacccttcagtcgaacggtaacaagttcgactcgtcgcgcgaccgcggccagcctttccgcacccgcatcggtgtaggccaagtcatccgtggttgggacgagggtgtcccccagctttcacttggccagaaggcccgcctgatctgcaccccggactacgcttacggtgctcgtggcttccctcctgtgattcccccgaactcgacccttgtcttcgaggtggaacttcttgccatcaacggcaagcagtaa

SEQ ID NO: 1260 - protein, 112 aa, Malassezia pachydermatis
MGVTVESISNGDGKTFPKAGDTVDMHYVGTLQSNGNKFDSSRDRGQPFRTRIGVGQVIRGWDEGVPQLSLGQKARLICTPDYAYGARGFPPVIPPNSTLVFEVELLAINGKQ

SEQ ID NO: 1261 - DNA, 465 bp, Hordeum vulgare (Barley)
  CDS (1)..(465)
atggcgaagccggggcttcttctctgcctgctggtcgtggccgccgcgctcctgctcgtcgcctccgccaagaagtccggcgacgtgtcggcactccagatcggcgtcaagtacaagccagaatcgtgcagcatctcggctcacaaaggagacagagttaaagttcactaccgtggaacacttaccgatggaacagtttttgattctagctatgaaaggggtgacccaattgaatttgaattgggcactggtcaagtgatcaaaggatgggatcagggaattttgggcatgtgcattggtgagaagaggaagctgaagatcccttcaaagctcggctacggggatcagggatcaccacctaccattccaggcggagcaactctcatattcgacacagagcttgtcgcagtcaatggcgagccttctagcaaatcagacgaggatgtcgctgatagtgatctgtag

SEQ ID NO: 1262 - protein, 154 aa, Hordeum vulgare (Barley)
MAKPGLLLCLLVVAAALLLVASAKKSGDVSALQIGVKYKPESCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDVADSDL

SEQ ID NO: 1263 - DNA, 459 bp, Rhodopseudomonas palustris
  CDS (1)..(459)
atgcgtttcgcttttcccgccggcgctctgctggctttggccgttactgcgctgtctcccgccgcggccctgatgtcgagcacccccgccatgtccgaatccgccaaatccgtcaccactccgtcgggtctccagatcgtggacacccaagtcggcaccggcgcgtcgccggcgcgcggccagatctgcgtgatgcactacaccggctggctctacgagaacggcgccaagacccgcaaattcgactcctcggtcgaccgcaacgagccgttcgaattcccgatcgggatgggccgggtgatcaagggctgggacgagggtgttgccagcatgaaggtcggcggcaagcgcacgctgatcattccgccggatctcggctacggcgcgcgtggcgctggcggcgtgatcccgccgaacgcgaccctggtcttcgatgtggaattgctcggcctcaagtaa

SEQ ID NO: 1264 - protein, 152 aa, Rhodopseudomonas palustris
MRFAFPAGALLALAVTALSPAAALMSSTPAMSESAKSVTTPSGLQIVDTQVGTGASPARGQICVMHYTGWLYENGAKTRKFDSSVDRNEPFEFPIGMGRVIKGWDEGVASMKVGGKRTLIIPPDLGYGARGAGGVIPPNATLVFDVELLGLK

SEQ ID NO: 1265 - DNA, 360 bp, Corynebacterium diphtheriae
  CDS (1)..(360)
atggaaaagccccagatccaggttcccgaaggaccagccccagaagacatcgttatcgtcgacctcattgagggcgatggcgcagaagcacagccaggtggccttgtagaggttcactacgtaggcgtcgactttgaaaacggccaagagttcgactcctcttgggaccgcggccaaagcatcgagttcccattgtctggcctcatcgctggctggcaagaaggcatcccaggcatgaaggttggcggacgccgccagctcaccattccaccagaggcagcctacggtcctgccggtggcggacacccactgtccggtcgcaccctcgtgttcgtgattgaccttctcaacgtcggctag

SEQ ID NO: 1266 - protein, 119 aa, Corynebacterium diphtheriae
MEKPQIQVPEGPAPEDIVIVDLIEGDGAEAQPGGLVEVHYVGVDFENGQEFDSSWDRGQSIEFPLSGLIAGWQEGIPGMKVGGRRQLTIPPEAAYGPAGGGHPLSGRTLVFVIDLLNVG

SEQ ID NO: 1267 - DNA, 348 bp, Bdellovibrio bacteriovorus
  CDS (1)..(348)
atgacatcggaactgcctgaagtaaaaatcactgacaccgttattggaaccggccagaccgccagcaaaggcgccctggtgttttgccactatgaaggatttctggaggacggaaccaagtttgactccagctatgatcatggacgtccttttgaatttgtcgtgggttccaagaaagtcatcgccggctggagcctcggatttctgggtatgaaagaaggtggtaaacgcaccatctatgtgccagcccacctggcctatggcgaacgtcagatcggaaaattcatcaagccccattccaatcttatttttcatgtcgagctgatcgaggcccgtccgcgcgaataa

SEQ ID NO: 1268 - protein, 115 aa, Bdellovibrio bacteriovorus
MTSELPEVKITDTVIGTGQTASKGALVFCHYEGFLEDGTKFDSSYDHGRPFEFVVGSKKVIAGWSLGFLGMKEGGKRTIYVPAHLAYGERQIGKFIKPHSNLIFHVELIEARPRE

SEQ ID NO: 1269 - DNA, 453 bp, Methanococcus maripaludis
  CDS (1)..(453)
atgattaccaaaggagatacaataaaagtagattacaccggcagatttgaagaaggggaagttttcgatacctccgtagaaacagtagcaaaagaagaaggaatttttgaagaaggaaggccatacatgcctttagagtttactgttggcgaaggtcagttaatccaaggctttgaagaagcagttttaggccttaaagttggagaagaagtaactgttacaatccctccagaaaaaggatatggatttagagatgaatcattaattgaaagagttccaattgaagctttcgatcaagcagactttgaacctgaagaaggaatggtaattgttgctggtgaagaacctgcggtaattttagaagttactgatgaagatgtcgctcttgacttcaaccacgaattagcgggagaaacactacaatttacaataaaaattatagaaaaactttaa

SEQ ID NO: 1270 - protein, 150 aa, Methanococcus maripaludis
MITKGDTIKVDYTGRFEEGEVFDTSVETVAKEEGIFEEGRPYMPLEFTVGEGQLIQGFEEAVLGLKVGEEVTVTIPPEKGYGFRDESLIERVPIEAFDQADFEPEEGMVIVAGEEPAVILEVTDEDVALDFNHELAGETLQFTIKIIEKL

SEQ ID NO: 1271 - DNA, 25 bp, Primer
ttagttgaccttcaacaattcgacg

SEQ ID NO: 1272 - DNA, 25 bp, Primer
atgtctgaagtaattgaaggtaacg

SEQ ID NO: 1273 - DNA, 2079 bp, Saccharomyces cerevisiae
  CDS (1)..(2079)
atggggaagagagtatacgatccaattcatgatactttccaactacgagaagacaattctgacgaaacaaaagcagattctccaatgcaatctgtaaaatcgggatcacaagaagaagcatccccaagctccattcaatcagagaccgagactgtgactacaaaaagcattccagttatacacgagattgaaatcgacgataaaaatgatgatgactccacgcaaagtgaagaagaaaataccaacatcttgctcaacttcgaaccttctacagtgcctgaagcaacaggagcaagtacggcaacggggccagtgacaactaacactgttagaaggaaacccaaagaaagcaatgccagtaaatacaatcgtcatttgaagaaacctgacggcgagccattcaatagaaaggacattcagttcagtttcatgcaagaactgttgatggacaagaggcaaatcttcactaatgttctaaaacccctatacaagaactctattgtacccattaatatcgatggcgataaattatcaatcaacgtgaccgacaaagagtacgatgcaaggacatttgtatttaacgataaattgacgttcgcacaattgtatgtgttgacaatagccacttctatcaaatgttccaaaattctcagagataaactattattagaccaacaagtagcattttctacttgtgttttagcgttattggtcaacattggtaggttgaacaccactataaatttttatttagaaatgacatcgcaattgagaacttttcactccgtgccagttttacaattacatgccaatgatccgaaacttttgcaggatacacctagactgaaatctattctgaaaaatctgccgtggggcaatgagcaactctcattgatggagacttacaaaaaggtcgaccaaaatgatggtgaagtggacaccgttaacaaatttaacattattaatatgttgtttagcatatgtgataattccggcctaattgacaagaggtttctttccaagtatgtggaagtcgaatcgaaagctcaggagcaagatatggtagatgaacagaatgaagtaaaagaaacggaagcggaaaatgaaaaacaagaatcaaaagcagcttatgcaacaacattatttgatatactggactattcgaaatacgagccaaaggatagatcaaacatattgatttggctgctatatattcatttggagacaaacttaagccaggaggaggtcgaagaatcagtaagatttttcaatggattggaagatggtgcacctgctggaaagttcattttaaggtgtacggaacgcagttacgacacggatcctgaagatgaattagagttcggagccaaccaacgcatcaagagaagagaattcatgagtaagatggaggagggtaggaagcgcgagcgtaccaatgttacagaggtgaaaaagcccagtatcggtggtgacaagagtgaagaggacggtgaaggggaagatgacaagagcgaggagactgtagaggagactagatcacttttgacgcctacgcccatactggaatcttcttcacccatgacattgaacaggaaaaaagtcacaccacaactgcccaaagtaacgccagcagcaccaacagaaacagaagaagaaatcacctccgctgctatcattgacaaaaacgatttaaatctaacaccattgaaaaaatacaatagttcggctacggtaaacaaggtcgacaagctaatatcgctagatctgaacaagcatgtgtcagaaaatggtaagacacaagaggagtttctcgccgatttgaaaaaatcccaggtgccaaacaggttgaaaagacgcgatattgggttaatcaagatattcaatgaatttgaagacatccccgtagcgtcagtgcttgggattcgcggtaaaaagagaaagaaattcaaagataatttgcttggatttgagacggatttcatgaaaaatctcggcgcttcaaagaaagtacttttaaataaaatcgaacgcgcggaaattgatgacgaagaagcaaccgccatgtttaagctggagtga

SEQ ID NO: 1274 - protein, 692 aa, Saccharomyces cerevisiae
MGKRVYDPIHDTFQLREDNSDETKADSPMQSVKSGSQEEASPSSIQSETETVTTKSIPVIHEIEIDDKNDDDSTQSEEENTNILLNFEPSTVPEATGASTATGPVTTNTVRRKPKESNASKYNRHLKKPDGEPFNRKDIQFSFMQELLMDKRQIFTNVLKPLYKNSIVPINIDGDKLSINVTDKEYDARTFVFNDKLTFAQLYVLTIATSIKCSKILRDKLLLDQQVAFSTCVLALLVNIGRLNTTINFYLEMTSQLRTFHSVPVLQLHANDPKLLQDTPRLKSILKNLPWGNEQLSLMETYKKVDQNDGEVDTVNKFNIINMLFSICDNSGLIDKRFLSKYVEVESKAQEQDMVDEQNEVKETEAENEKQESKAAYATTLFDILDYSKYEPKDRSNILIWLLYIHLETNLSQEEVEESVRFFNGLEDGAPAGKFILRCTERSYDTDPEDELEFGANQRIKRREFMSKMEEGRKRERTNVTEVKKPSIGGDKSEEDGEGEDDKSEETVEETRSLLTPTPILESSSPMTLNRKKVTPQLPKVTPAAPTETEEEITSAAIIDKNDLNLTPLKKYNSSATVNKVDKLISLDLNKHVSENGKTQEEFLADLKKSQVPNRLKRRDIGLIKIFNEFEDIPVASVLGIRGKKRKKFKDNLLGFETDFMKNLGASKKVLLNKIERAEIDDEEATAMFKLE

SEQ ID NO: 1275 - DNA, 2253 bp, Neurospora crassa
  CDS (1)..(2253)
atggccgcctcacccagctctcgtgctgcctctcctgcactgtcagatgtcgacactcccagttcccccgcccaccaacccggaaagtcttcgcacactgccgccagcgtaaccgaggacaacgacgctaccatggctgccacccccgagccaagcgagtctagactgcctcgtgggaaaagaggccgtggccgcgatgatggatcagggaccaacgttattgggaagatccggcatctgaaaaaggaggacggagaaccgctctggcgaaaggacatccagtacgacttcctcaaggccgtgttcgacaacgaacaaaaggttttcaccaacagctacgaacccgacaagattggcaagcagtgctttgccgatctctacatcgacacaatgtcgaggagtagcaagacatcaaaagtccttcgcgacaagctgcttagtgatcgtgatgccgcaaaaggaatggccatggtgtgtctcctcgtcaacattggtcgtatgaacacgacccttaacttctttcccgaaatgcgtgcacaactccgtacataccacgccatcccttcgctccaggcccagcaggacccccatgcgtacaagcaactgcaggacgcaccccgtctcaaatctattctgaaaggaggcgccgaagacagggatgagcccaactccatcgacgccatcaaggcgcgtgccacccacgtacccaggacaaatcccgtcaacctcttgttcgtcatctgccaacaggctagcaagatcgccgagctgcatttcccgcctggtcgagagttccatgacttgatcatgaagaccaactattccagcaccagccgcgctcgtgcctttctatggctcatgtggttctaccttgaatctgactttactgaggagggctgcgatgagaatcccttcggggcaggtgttgactacgggctcgacgttgcaaaccagggcgtaccgcgcttggtagagatgacgaaagaagaagaggaggccgagaacaaggatcccgacgaagaaatcaagttcggcttggacaagcaaaagatgcgagccaagatcattgaggcagaccagcagttcatggtcgagagccaaactagaaagggtggcagaggccgtggcttccctgctggtgatgagattggtcccacaactggcattcttccccgaatcaggccttccaaggttgatagcgacctggacagcatcagatctactccgccgcctagggctctggtcggtaggcatcctgccgcttttccacagactactaaccgtaggggtggcaactccctaaaatatcagatcttcgaaggctcatcgcccgccggtggccagatgctcgaaggtgttgtgcacaggaaacctcgtccaccgaccgctcatcagcttgccgtcgaacgtaataggtcccaacgcgttgagtggattctggacagaggactcacgcgaagccaccatcgcagccgaaagcagcgtcgcgtcgatggctccattatccgtgtggtcaacaggctcgacaaagccaaggaatgggctgacttcagcgatagcgaggacgaggagactgttaactataataagcaggctctcctcgcaggggccgtgaactacaccggattcggagagaattaccccttccgagagaaaggctacgttggtctctgccagctcaaagacgaagatgatgactttggagaggaattcgcctcgtactcggcctccctaaggcgcgcccagcgccgactcagccggtgggaggagtccaatgatccggacctcggcgttatcaggccgattaagcggccaaagctcactaatggagatgccaacggcgatggtgaaggccacggtgacgaagacgacggggagggttcgccgtccaagcacgacatcgatccggcggaaactgaggacgaggccgaaattttggagcgtaatgcccgtcgccgtgcttacgtccccgccaacaagccggtaattcttcgcactggcaagatgaacggtatccagagacaggacaccgctgattcccacgatgccgatacgcccatggacgatgtcgatgatttggatgacgatgacaaggcgctacttggcctaggcgacggtgaaggcgaaggtgatgacgttgaggatgacgccgatggtaacgatgatggtgaacgggacgccgaggaccaggaagacctggacgatcttgacaagacattgttaggcatggacggtgattcagaatcagagtag

SEQ ID NO: 1276 - protein, 750 aa, Neurospora crassa
MAASPSSRAASPALSDVDTPSSPAHQPGKSSHTAASVTEDNDATMAATPEPSESRLPRGKRGRGRDDGSGTNVIGKIRHLKKEDGEPLWRKDIQYDFLKAVFDNEQKVFTNSYEPDKIGKQCFADLYIDTMSRSSKTSKVLRDKLLSDRDAAKGMAMVCLLVNIGRMNTTLNFFPEMRAQLRTYHAIPSLQAQQDPHAYKQLQDAPRLKSILKGGAEDRDEPNSIDAIKARATHVPRTNPVNLLFVICQQASKIAELHFPPGREFHDLIMKTNYSSTSRARAFLWLMWFYLESDFTEEGCDENPFGAGVDYGLDVANQGVPRLVEMTKEEEEAENKDPDEEIKFGLDKQKMRAKIIEADQQFMVESQTRKGGRGRGFPAGDEIGPTTGILPRIRPSKVDSDLDSIRSTPPPRALVGRHPAAFPQTTNRRGGNSLKYQIFEGSSPAGGQMLEGVVHRKPRPPTAHQLAVERNRSQRVEWILDRGLTRSHHRSRKQRRVDGSIIRVVNRLDKAKEWADFSDSEDEETVNYNKQALLAGAVNYTGFGENYPFREKGYVGLCQLKDEDDDFGEEFASYSASLRRAQRRLSRWEESNDPDLGVIRPIKRPKLTNGDANGDGEGHGDEDDGEGSPSKHDIDPAETEDEAEILERNARRRAYVPANKPVILRTGKMNGIQRQDTADSHDADTPMDDVDDLDDDDKALLGLGDGEGEGDDVEDDADGNDDGERDAEDQEDLDDLDKTLLGMDGDSESE

SEQ ID NO: 1277 - DNA, 24 bp, Primer
atggggaagagagtatacgatcca

SEQ ID NO: 1278 - DNA, 23 bp, Primer
tcactccagcttaaacatggcgg

SEQ ID NO: 1279 - DNA, 924 bp, Saccharomyces cerevisiae; identical to SEQ ID NO: 736
  CDS (1)..(924)

SEQ ID NO: 1280 - protein, 307 aa, Saccharomyces cerevisiae; identical to SEQ ID NO: 737

SEQ ID NO: 1281 - DNA, 25 bp, Primer
atggttcagcaactaagcctttttg

SEQ ID NO: 1282 - DNA, 27 bp, Primer
ttatattagaatatttccatgtgctac

SEQ ID NO: 1283 - DNA, 1716 bp, Saccharomyces cerevisiae; identical to SEQ ID NO: 230
  CDS (1)..(1716)

SEQ ID NO: 1284 - protein, 571 aa, Saccharomyces cerevisiae; identical to SEQ ID NO: 231

SEQ ID NO: 1285 - DNA, 2817 bp, Neurospora crassa
  CDS (1)..(2817)
atgtcccgttcgaaccccgccctagcggcgcgctacaccgacaatgaggacgccgttatgattgacgtggacgacgtggaggatgacgacgacgaagacgaggagatggtacagctgaagctgcaggaaatccaggcgcgcatgaagttgaaaaagatacaaaatgcaaaggcgcaaagaagggctaactcgtccatggatgcacgatcgaatggaggccgaccagaaagcgcttcggccaacaacaacaataacaacaactcgatgcagcccccggccggacttcccattcagtcaaggttagctgcggcaagagataggatggaacaacagtcaaattccgttcagatccccgcttcgccggtcaggaggggacgtagtgaatccgctcctcagccacctcagtcccccacgaggctcatgttgggaatcgacaagggacgaaaagcggccgacatgtcactgaaaagggcgcccacattacgaaaggtcgaaagcgaacgtccctcccagaatctaaactcccaacagtcaggctacttgcgacggtccatgacgacatcctttagcgaagatcaacccagctctagctcccgtcgtcctgtcagcttcgacgggcgcgcaagttctttctcgcaggcagaagaaaggcgtcctttaagtttcaacgagcgtctagcatgcgccaggaacgaagagcaggagcgcagggaaaaggcacagaggatacagaagatcaggagtaatgccttcagtatcggcagggaagagatggaggagtacaagacaaaagcggtggatgttcccgaagttccatacaaagccccagaatattctcgcgacgatatcctgtcagcgactggaagatcttcatcaaggccaacaaccatgagcgcatcatcatcgttcacacaaccaagctcaacacaagtcaactcggacaatgaacctggcttcgaaccttattcaggtcttcgcctgtccaagcgcattcttccccataatgtggtcactcgcgctattacaggcaagaagacctacggtttgaaggaccttttgcggcaagtcaaggcaccggactggtcccttcccgatgtcgagtctgatgtagtcgttttcgccattgtcgcaaccaagtctgaaccgcgcagccatcgtagcgatggcaagcccttgcaagaacgtggcaagtacatggtcatcagcctctgtgatcttcagtatgaagtggaactgtttctctttaactccggattcgaccgcttctggaagctcacgccgggaaccattctcgccatcctcaaccccaccatcatggcgccaaaacaaggtcagcaagatactggtcggttctcattggtgatcaacagcgatgaggataccattttggagattggtaatgcgcgcgacctaggttattgcaagagcatcaagaaggatggcatgctttgcaagagttgggtcaacctccgtcgtacagagtattgcgagttccataccaacgaagcagtcaccaagtcgagacagggaaggttggaattgaacaactcattcgggtttggagacaaatataagcaaaactctaggtacgccaagagtgaagaggccaagagaaaagaggaggaaatacgactgaggggtcaatacgaccggtcaaccggcagtcacttcttcatgaaccgtactgccgcggagctcattgatggcggtggcatggctgatcaggctgagaagaaggaggctatcaagagaagcttggcgaggaaggagaaggaagctgagattgcaagaaaactgggcgaggtgggtggtggtgctgggagagattacatgagtcgagccgctggtggtcttcgcgcaagtttctcttctaccaattcagtacccatgtcaggctctacctccttctcgtcagccacagcctcgacacccatgtcgtcactgtctggccacagccaaagcaacagcacaaatgacccgctaggctttggcggcagaccccgatatgaccttcaagccctcggtctactccgcaaaaagggcgaagaacaacccaaaatcgatctcggcccaataaagcgcaagcgtcccgagtccgcccagtcaagtgaaaacagcttcagcaagtccaactctaccagcagcgcaaccatcaccccctccaactacaccaccaacacgaaagccccctccttgggctggggctccagcctgcgcgacaagctttcgagaatgaaagaaggcgagcggctcaacctttcccaccgccccagcaactccagcatgcgcgattccacccccgcccttaccaactcctcgtccaccaccgcttcgaccggcctcaccccggccatcaaccgtctctccacctccgctagagacttcaactttacaaactcctcctccaacacccagactaacctccctaaccgcccctcacccgccgtccgcttctccgccgcccccaataattcttctggtactacaaccaccaccaacggtcccaccacttcccatcaccaccaccactcctcctccttatcctcctctcgcctcctcggcgtctccgcctccgcacgtctagcagctgcgagagcagccgccgccgcacaagctgctgctgctgctgatgggcactcgcaagggtcgcaaccgcctgtcagaaaaaagacgcggttcgtgacggataaggggatcagagaggcgggcagggatagtctgggggacaaggggtttttgatgagtgcggcgcagaagaataggaggcaggtggtgctgagcgaggatgatgatgatgacttgattgttttgaaatga

SEQ ID NO: 1286 - protein, 938 aa, Neurospora crassa; identical to SEQ ID NO: 239

SEQ ID NO: 1287 - DNA, 2658 bp, Mus musculus
  CDS (1)..(2658)
atggatgtggaggaagacgacttgtgtctcctgacatctctactggaagagaatgaggcagtcttaccttgcagctcagaaaaggataagtccttgtctctgggagacggggaccctgatgaatttgatgagctctttgatgctgatggtgatggtgagtcttacacagaagaggctggcagtggagaagagggcaagactggaaaccaggaggaacgtttggccactctctttggtgatgtggaggacttaacggatgatgaagttgctacatcgaaagttggaaacagtggcccccctcctgctcccagccaagagaaaaccagcgaggagctgcaagatgaattaaagaagttgcaagagcaaatgaaatccttacaggagcagctaaaagctgcatcaattaaacagcctccagggacagcacccttgcaggaaccacctgattcatctctgcagccactgcttaaggagaagagaattcggagaattcaggagtcagcgtgcttttctgcagagcttgatgtccccactttacccaaagccaagcgggttgctcggaagccaaagactcctgcagagtcatcttcaaggatgcgtacacccgcacagccactacaggtttcttccagttttctagagcctaaccactcctcttcttcgagatcaagcacaccctcacctcaagctgttcctggaaacaaatgtagcaggacaattagaaatcaaaacacagtgtccccagggaattctggggaccggccccagcaggtttcccaggtctctgtggaagccttctcaggcctacgcctcaggcgacctcgagtctcctccacagaaatgagcaggaagatggcaggccggaaactaatcagactgcctcagatcaaggagaagatggcaactgagaacctggaagagacagactgggtgacgtttggggttatcctcaggaaggtcactccacagagtgctaccagtgggcaaacgtttagcatctggaaactgaacgaccttcatgacctgactcagtgtgtgtccttgttcttgtttggagatgttcacaaagatctctggaagacagagcaagggaccgtcataggcttgctcaacgcaaaccccatgaagcccaaagatggcttgaaagaggtgtgcttatctattgatcatcctcaaaaagtcttaattatgggagaagctatggacctgggagcctgtaaagccaagaagaagaatggagagccatgtacacagacagttaacttgcatgactgtgaatactgccagtatcacatccaggcccagtacaagaagctcagcgcaaagaggactgatctgcagtccactttctctgggggacggattccgaagaagttccgcaaaggcaccagcctgaaggagcggctgtgccaagatggtttctactatggtggtgtttcttccgaatccttcgcagcgtccagggcggcggccattgctcctaagaagaaggttcaaaccacgctgaccaatctggttgtccggggcacaaactcgatcatccaggaaacaaaacaaaagcttggtattccccagaagagcttgtcctgctctgaggagttcagggaattgatggccctgcccacatttggagccagaaacttacaaaagcatctagccagagccaaggcttcagggagttccaaacctgccatccagtccatctcagcatcagccctcttgaagcagcagaaacaacagatgctggagatgcggaagaggagatcagaagacatacagaagcgattcctccaaagctcaagtgaagtccagagcccagcagtgccgtcttcctctcgacaggctgctgcccagtctcctcgaactggggctgagttccccaggttggaaggaactgcaaccccacggatgcccaagctgggcagaggcatctcagaaggggacgatgttctcttctttgatgattcaccaccaccaagaccaaaactgagcgcagcagcagaagctaaaaagttagttgctattgcaaaattaagggcaaaaggccagattctcacaaaagtagatccaaacaatactgtaaggaagcaaatggatggccgagccatgctgggagtgaaggagcgtgtggagaatagcaacacagtttctcctgaagaggagctggagcctgccaggaaaaaaaggagagagcagcttgcctacttagagtccgaggaatttcagaagattctaaaagcaaagtccaagcacacagacatcctgaaagaggctgaggctgagctacagaaatcctattttgagccactggtgaaaaaagaacagatggaagaaaagatgagagccacccgggaagtgaaatgccgcgtggtgacgtgcaggacgtgcacctatacccacttcaagcctctggagacctgtgtcagcgagcagcataacctccactggcacgacggcgtgaagaggtttttcaaatgtccctgtggaaacaggaccatctccctggacaagctcccaaacaagcactgccgtaactgtggcctctacaagtgggaacgggatggaatgctgaaggagaagacaggtccaaagataggaggagagaccctgctgccgagaggggaagagcacgccaagtttctgaacagcctcaagtga

SEQ ID NO: 1288 - protein, 885 aa, Mus musculus; identical to SEQ ID NO: 245

SEQ ID NO: 1289 - DNA, 2583 bp, Xenopus laevis; identical to SEQ ID NO: 246
  CDS (1)..(2583)

SEQ ID NO: 1290 - protein, 860 aa, Xenopus laevis; identical to SEQ ID NO: 247

SEQ ID NO: 1291 - DNA, 2568 bp, Homo sapiens
  CDS (1)..(2568)
atggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaagccttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagtgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagcctcagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttga

SEQ ID NO: 1292 - protein, 855 aa, Homo sapiens; identical to SEQ ID NO: 241

SEQ ID NO: 1293 - DNA, 2625 bp, Homo sapiens; identical to SEQ ID NO: 242
  CDS (1)..(2625)

SEQ ID NO: 1294 - protein, 874 aa, Homo sapiens; identical to SEQ ID NO: 243

SEQ ID NO: 1295 - DNA, 2076 bp, Caenorhabditis elegans
  CDS (1)..(2076)
atggatcccctagatgacctactcacacagctcgagggagtcgaagaagaggagctaaagcctgtaaaccgagccccgcggcttctgaacatggaagaagcctgcgaaaatcaaggttctagtgagaaacccagcgattctagctcgaaaaatcgatatgaagatgatgatagtgatgatgaggagctttatgtgaaaaaacgagagctcacggagcaaggagctcttttaaagcggcatctggagaagaatagctcaacgagtgggccaaaggccacagatgcttggaaaactaataaaaaatcagtgctcaccgggctcacgaaaccatccaccgacacagtaaccgtcggaattgtgagattcgacaaatttcaaatatcgattcggaatccgaaaatttcggcgacaagttttggagcatttactgctggaatgaagcttgaaaagctatcaaatctgaaaccaacgtcaaatttcaaagaagcatggtgcacgattggtgttattgtggaaaagggtttcaagaagaaaagtgcaaatggaaatgattttttgatttggaaattacatgatttaaaggactgtcaaacccaaccagtgaagcttctaatgtttggagacgctattaaagatcactgggagattaagctgggctcagtaattgcattgatttctgctcaaattgccgatgattcgactgcttccggagctaaaaaaaccgtgtcggctacgctgaaagtggcaaaatcgaataatatcgtggaaattggacaatccgcacattttgggacttgtaagggaatccgacaacaagacggccaacgatgcagtaattttgtaaattcttcgctcagcgaattctgtgtattccacgtgatgagcgctgcgaggaaattgtcggctaagagaggtgtgttcaacgcggtgacatgtggcccaaacgtgggcggcctctcattcaacaagaagcccggcacgccccgcccaccgatttccagccgaccaggaatttccggctccggacttgccacctccagcggctccccaatgctccgtgacacaatgcgaccagcagacagcttcacgctgaccacaccgacttctggcctgaaaaagattacaaaagaggaggagaaatcgtcgttaaatgatcttttgagccaaagaaaaaacacgtttgccgcccgtcaaatgctgaaactcaaagagaaaaaagatgagaaactggctgaaagtgtggaggaaatgattgaatttttgggaactacaggcggcgaagaaaagccatcagttcattcgagttttggcgaatttctagcagccgacacccgacgggaaaaggcggctactgtcgatttacgagcttcttctgcaacttctggaacaagtgcttcttctccaggcggttcaaagctatggacaatgtcactggcgaataagaaagctgctccgttaggtcataaagatgctcaggagcatgccgctaggctccgcgcaatcgcaattctcaaggcaaaacgaaaagaagccgaaatggagaagctcaccggaggcggcggcggagtcaagcgaaaagcttccggaacaccgacggctccggagcccgaagcaaagaagccgagaagccagaaaatggatgagattcgtgcgatgctcgccagaaagagcacacatcacaaggaagcggagaaggcggagcacgacatgctccagcgtcatttgacaggaatggaagaacgcgaaaaagtggaaacatttacgacgacttgtgttgaagttaaaaatgttaaagttgtcacgtgtaatcagtgcaaatacacatcacaattcgcatcatcagaatgtattaaaaaagagcataaactcattaaacacaccgctgacaagcgattcttcaaatgtactggatgcaaaaaacggactgtttgttttgaaatgatgcctgtcaagcattgtgcgcactgcaacgagaacaaatgggagcgcgtagcgatgaaagacgaacgaaaagtggttctcgacacggaaaatctgctgctccgcggtgaagaacgtccgtttgttggctcctga

SEQ ID NO: 1296 - protein, 691 aa, Caenorhabditis elegans; identical to SEQ ID NO: 235

SEQ ID NO: 1297 - DNA, 1782 bp, Schizosaccharomyces pombe
  CDS (1)..(1782)
atgcatgatcccttcattgcagaagaaaatgacttggacctggaagaaaagaggttacagaggcagctaaatgaaattcaagaaaagaagcgtctacgaagtgctcaaaaggaggcttcttcggagaacgctgaagttattcaggttccaagatctcctcctcagcaagttcgtgtccttacagtcagctcgcctagtaaactaaaaagtcccaagcgattgatattaggaatcgataaaggaaagacggggaaagatgtttcattaggaaaagggcctcgagggcctctaccaaaaccatttcacgaacgacttgcagaggcaaggaaccaagaaaggaagaggagcgataaattgaaaacgatgaaaaaaaatagaaagcaatcgttccagaggaagcgaaacatacttgaagatggaaaaagtgaagaggagaaatttcctatgaaatgtgatgaaatcgatccttattcaagacaagccattgttattcgatacataagtgatgaggttgctaaggaaaatatagggggaaatcaagtttatctcattcaccaactactcaaactagtaagagctcctaaatttgaagcgccagaagttgacaactatgtagttatgggcattgttgccagtaatagtggaaccagagaaactgtgaatgggaataaatattgtatgctaacactgactgacttgaaatggcaactggagtgcttcctgtttggaaaggcgtttgaacgatactggaagatccagagtggtactgtcattgcgcttctcaatcctgaagtactaaagccaaagaacccagacattggacgcttttctctgaagctggattctgagtacgatgtacttttagagattggtcgctccaaacaccttggctattgttccagccgaagaaaaagcggtgaactatgtaaacattggctcgacaagcgtgccggagatgtatgtgaatatcacgttgacctcgctgtccagcggtccatgtctacgcgaacggagtttgcttcaagtatggcgactatgcacgagcctcgcgcacgacgtgaaaagcgatttcgtggacaagggttccaaggatactttgctggggaaaagtattccgcaattcctaacgcagtagctggtttgtatgatgcagaagacgccgttcagaccgagagggagcgcaaggaacgatacaaaaaacaacgagcgcaggctgaacgcgagcgtgaaattttggtgcgattatcgaagcgatgttgcgcttcctcttcgtctagctctaactcgaataacctctctacgggaatgtcgatgcgaacactcggccatcagtatctaaatttacaaggttccggcgttaaaaatttacatgacaagggtaatcccactgctctttctaaagatagcgaaattgattcatcgacgaaaaaaccatccgttctggcctcttttaatgcatctataatgaaccctaaatcctctctaccatctttttctaactctgctattctcggcactaacgatgcggcatcagggacacccgttccacaagatactacatccaccaaagtttccccagcggtagtgtttacctcttcgccgaggattttttccccccaaagtctacgaaaaataggtttcgatccaacgcattccgcagatgcatctacaacgcactccacagcgactggactttcacgatccggctccctaaaaaatatcaaattccgatatgaatttactgagagtgatgatgaggatgacttagaaatagttccctga

SEQ ID NO: 1298 - protein, 593 aa, Schizosaccharomyces pombe; identical to SEQ ID NO: 237

SEQ ID NO: 1299 - DNA, 26 bp, Primer
atgaatgatcctcgtgaaattttagc

SEQ ID NO: 1300 - DNA, 25 bp, Primer
ttatattatctcaagatcgctggca

SEQ ID NO: 1301 - DNA, 1992 bp, Saccharomyces cerevisiae
  CDS (1)..(1992)
atgaagttactttttaaaagatattcgtctagtcatattggtaagctgattaaggactctttaatcactcctgaaatactaccacagctagggcgacagccatcatcgcataaacgtttaccaaataacaaaagaactaactcaataactgataaatggttgaaggatgcgctaacaagaaaagataaactgaatgaagataagctccaaaatgtaaatttacgattaaatgtggtactgactactctacagaagcttcgtacatccgataatcctgctttgtattttgcgttgttgaatcgtattggcacaggtcacataaaatggctaaataaaagtggccgacagattgatgcattcccacctgatcggctgcctttggaattttatcatgagctatctaatatgctctataaactatcgcttcggtccgcaaatgacaaaattgcactagctaaattttcattgcaattattggatcgctattattttcttaaaaccaaatctttaactatagaaggaaaatttcgggcaaacataaaatttttgaggaattgtactcttttaattgttaaatcccaatcgaactactacttaagggcaatacagcggttgttcgcggaaaattcggagggtcaattattagccaatttatcccagctggcattttatgtggagacctcccaatggacaagtatgttggatattttatcctcatgtgtaccggattctggtttaagaggttcgaaggagcgtgaaagagctattcaattgttggagttatttagtccatgcctagtcaaaagtctaaaagtaatgatagcacaaaatatggagaatgaagcttgtcagattttaaggagcttgtctgaatggaactttcattttgatcagcatgattcctccaacttgatacaattatcccagaaccattcttgcctcaaagttattgaaaccatgaatggattatcatcaactaccgctgtcactaggcaattcggacttgaaaaattaccaactgacgtgagtttgaagcagagcatacatattttatcaaaagataatttcgaacctctcaagcaagattcatttcttcaatttctatcgtttaaattaagtgatttgcctctgaacttagaagtatggaaaaagcacattaaggaggttgatgaccaaatgcaggctgagtccaacctgcattccttaagagctttttttattgatatgctactgtgtcacttatctgtgcgcaaggatttcgattttatgctttcattggtcgagcacatagtatacgaaaaaaatttatggcagccattattactcacagataatatagttggaaacaaagaaaattccacttttcattgcctctttcatggcgcctctcaagatatttctaccaaacttactctactggcattgtataaccagttgaatgaaatcggctatcaatttacctcccacgattttctctcgatgttgaaagtctgcaaaaactactctgattctgattttttctattttgctttctataatttgttggttacacaaagtcacaaattttttcttttcgataagtttagtgataagttttcgtggaggttgccaatacaaatcggagatgcaatttctgaatggctatccagcttagaaattgatatacaagaaaacaccgatagagttttgcagataacagatgacgtcggcgaatggtatgttgagaataaaccatttaagtcagaaaaagggaccattcaaccaataaacataatggaattgcgcaaaatttttggggagcgaaaaactctatttcatatggattcagaaattttccaaaaatctaaagcaaaaagagataaagaaatgcggaatgaagctttatttaccgcaaatgatgcggaatataattttgctgcggatgtatcctatgcaaagagagtagaaaatctattttcttacataagatctaagcaaatgcaacaaaaataa

SEQ ID NO: 1302 - protein, 663 aa, Saccharomyces cerevisiae
MKLLFKRYSSSHIGKLIKDSLITPEILPQLGRQPSSHKRLPNNKRTNSITDKWLKDALTRKDKLNEDKLQNVNLRLNVVLTTLQKLRTSDNPALYFALLNRIGTGHIKWLNKSGRQIDAFPPDRLPLEFYHELSNMLYKLSLRSANDKIALAKFSLQLLDRYYFLKTKSLTIEGKFRANIKFLRNCTLLIVKSQSNYYLRAIQRLFAENSEGQLLANLSQLAFYVETSQWTSMLDILSSCVPDSGLRGSKERERAIQLLELFSPCLVKSLKVMIAQNMENEACQILRSLSEWNFHFDQHDSSNLIQLSQNHSCLKVIETMNGLSSTTAVTRQFGLEKLPTDVSLKQSIHILSKDNFEPLKQDSFLQFLSFKLSDLPLNLEVWKKHIKEVDDQMQAESNLHSLRAFFIDMLLCHLSVRKDFDFMLSLVEHIVYEKNLWQPLLLTDNIVGNKENSTFHCLFHGASQDISTKLTLLALYNQLNEIGYQFTSHDFLSMLKVCKNYSDSDFFYFAFYNLLVTQSHKFFLFDKFSDKFSWRLPIQIGDAISEWLSSLEIDIQENTDRVLQITDDVGEWYVENKPFKSEKGTIQPINIMELRKIFGERKTLFHMDSEIFQKSKAKRDKEMRNEALFTANDAEYNFAADVSYAKRVENLFSYIRSKQMQQK

SEQ ID NO: 1303 - DNA, 28 bp, Primer
atgaagttactttttaaaagatattcgt

SEQ ID NO: 1304 - DNA, 27 bp, Primer
ttatttttgttgcatttgcttagatct

SEQ ID NO: 1305 - DNA, 603 bp, Saccharomyces cerevisiae
  CDS (1)..(603)
atggcaggtatcaagttgacgcataagctttatcagtattatcaattagccacaagctttttgtatgctgcattattgatacggtggctgatattaatgccactggtagggtctcggtttttaccgggaggaatccacgaattcttgatatatttgatgttttattccagcatcatggaagttatttggttgcttagattccacgggttcaaatatggtttgctttcaagaacgtttttgaaagacctaaattttatctatttagtcagcgtgatccatttttatgacgattatgagcatgcattgatcctcaagaatgcatcatattctagtttcattatttccttatctttatcacaggcatattgccattggtgcaaactttttaaacgtaagggcgtaaaggaaagaacacttgtatggaaggttaacacatttgttacattgccaattctctacctgagtgaatttgcattgctactattaaatatccaggttaagaactatcattctaccccgactttggacataatcaacagggtggttttactagcatacttccctgtactactaacagcatacaaaaaactattaacaaaatga

SEQ ID NO: 1306 - protein, 200 aa, Saccharomyces cerevisiae
MAGIKLTHKLYQYYQLATSFLYAALLIRWLILMPLVGSRFLPGGIHEFLIYLMFYSSIMEVIWLLRFHGFKYGLLSRTFLKDLNFIYLVSVIHFYDDYEHALILKNASYSSFIISLSLSQAYCHWCKLFKRKGVKERTLVWKVNTFVTLPILYLSEFALLLLNIQVKNYHSTPTLDIINRVVLLAYFPVLLTAYKKLLTK

SEQ ID NO: 1307 - DNA, 714 bp, Candida albicans
  CDS (1)..(714)
atggcatcattatatccattaaaatttaacgaaaaacttgcattcttttataatactgttgctgcaacattatggttttgttgtttaggtagatttcttattctacttcccttggtagggagaaaattcttacctggtggaatggctgatttctttcatgtggtttcattactaccgataattgaatcattatttgtgaaatcagtgttaaggaaaaaattcactatcacatcattatgggggattctgaatggattaaaaatggtgtggctatgttatggtgttattttccctcatcccaaaattgccaaacatacttcatattcattattaattacttcttggtgtttacaatatttcattcattacttttattatgcattcaaagtgaaaacaaagagttcatttcattttttgttttggttagaatacaataatttttacttgacttatcctttgggtttggtttctgaaatgattcttttattcttaagtcttgcctttgttgaacaagactcgatatatgattacgttttaagagcagcattcttggcttatattccaatagcatattttgcttggggtcatttgaaatcaagaaagaagaaaagatacaccgaaattatgaataaaagaaatgttagacaagtagcaactttagaaagtactactactagtactaagaatacctctattgaactaagaaatatgtaa

SEQ ID NO: 1308 - protein, 237 aa, Candida albicans
MASLYPLKFNEKLAFFYNTVAATLWFCCLGRFLILLPLVGRKFLPGGMADFFHVVSLLPIIESLFVKSVLRKKFTITSLWGILNGLKMVWLCYGVIFPHPKIAKHTSYSLLITSWCLQYFIHYFYYAFKVKTKSSFHFLFWLEYNNFYLTYPLGLVSEMILLFLSLAFVEQDSIYDYVLRAAFLAYIPIAYFAWGHLKSRKKKRYTEIMNKRNVRQVATLESTTTSTKNTSIELRNM

SEQ ID NO: 1309 - DNA, 24 bp, Primer
atggcaggtatcaagttgacgcat

SEQ ID NO: 1310 - DNA, 28 bp, Primer
tcattttgttaatagttttttgtatgct

SEQ ID NO: 1311 - DNA, 465 bp, Escherichia coli
  CDS (1)..(465)
atgcgtttctgccttattttgatcacagcactgcttctggccgggtgtagccaccataaagcaccgccgccaaatgccagactttctgattcgattaccgttattgccggtttgaacgaccagctacaaagctggcatggcacgccgtatcgttatggtggcatgacgcggcgcggtgtggactgttcgggatttgtggttgtgacgatgcgcgatcgtttcgatttgcagctgccccgtgaaaccaaacaacaagcctctattggcacgcaaattgataaagacgagttgctgccaggtgacctggtctttttcaaaacggggtccggacaaaatggtttgcatgtaggtatttacgataccaacaaccaatttatccacgcctctaccagcaagggagtgatgcgttcctcacttgataatgtctattggcagaaaaatttctggcaggcgagacgaatctag

SEQ ID NO: 1312 - protein, 154 aa, Escherichia coli
MRFCLILITALLLAGCSHHKAPPPNARLSDSITVIAGLNDQLQSWHGTPYRYGGMTRRGVDCSGFVVVTMRDRFDLQLPRETKQQASIGTQIDKDELLPGDLVFFKTGSGQNGLHVGIYDTNNQFIHASTSKGVMRSSLDNVYWQKNFWQARRI

SEQ ID NO: 1313 - DNA, 573 bp, Salmonella enterica subsp. enterica serovar Typhi
  CDS (1)..(573)
atggtcaaatctcaaccgattttgagatatattttgcgcgggattcctgcgattgcagttgcggttctgctttctgcttgtagcacaaccaccaataccgcaaagaatatgcattctgagacgcatgctgtgggcaatagcgatagctcttcactgcaagcctctcaggatgaatttgaaaatatggtgcgtaacctcgacgttaagtcgcggattatggatcagtatgctgactggaaaggtgtgcgttaccgcctgggcggcagcactaagaaaggcgtcgactgttccagctttgtacagcgcaccttccgcgaacagtttggtttagagcttccgcgttcaacctatgaacagcaggaaatgggcaaagcggtttcacgcaataacctgcgtacgggcgatctggttctgttccgcgccggttccactggccgtcatgtcggtatttatatcggcaataaccaatttgtccatgcgtctaccagtagcggcgtcattatctccagtatgaacgaaccgtactggaaaaaacgctacaatgaagcgcgtcgagttctgagccgcagttaa

SEQ ID NO: 1314 - protein, 190 aa, Salmonella enterica subsp. enterica serovar Typhi
MVKSQPILRYILRGIPAIAVAVLLSACSTTTNTAKNMHSETHAVGNSDSSSLQASQDEFENMVRNLDVKSRIMDQYADWKGVRYRLGGSTKKGVDCSSFVQRTFREQFGLELPRSTYEQQEMGKAVSRNNLRTGDLVLFRAGSTGRHVGIYIGNNQFVHASTSSGVIISSMNEPYWKKRYNEARRVLSRS

SEQ ID NO: 1315 - DNA, 465 bp, Yersinia pestis
  CDS (1)..(465)
atgcggacgcgcttttggatttttctgatcagtatggtccttgctggttgtagcagccatacaccaacacccagtggatacttatctgactccattgtggtggtcgctaaattgaatgagcagttacggcaatgggagggaacgccataccgtaacggagggttagatcaacgtggtgttgattgctctggttttgtttaccgcacattccgtgatcgttttgatatgcaactcccccgaacgacccttgcgcaaaccaccttaggcactaaagtctctcgtgatgaactgatgcctggcgatttagtcttcttcaaaacgggcagtggtcagaatggattacatgttggtatctatgataccaatgatgaattcattcatgcttcaaccagtaaaggcgtcattcgctcgtcattggagaatgtgtactggaaacgagtttactggcaggcacggcgtatttga

SEQ ID NO: 1316 - protein, 154 aa, Yersinia pestis
MRTRFWIFLISMVLAGCSSHTPTPSGYLSDSIVVVAKLNEQLRQWEGTPYRNGGLDQRGVDCSGFVYRTFRDRFDMQLPRTTLAQTTLGTKVSRDELMPGDLVFFKTGSGQNGLHVGIYDTNDEFIHASTSKGVIRSSLENVYWKRVYWQARRI

SEQ ID NO: 1317 - DNA, 465 bp, Salmonella enterica subsp. enterica serovar Typhi
  CDS (1)..(465)
atgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgctacggcagcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaa

SEQ ID NO: 1318 - protein, 154 aa, Salmonella enterica subsp. enterica serovar Typhi
MRFWLLVITALFLAGCSTHRAPAPNARLSDSITVIAGLNDQLQSWRGTPYRYGSMSRRGVDCSGFVVVTMRDKFDLQLPRDTREQSKIGTRIDKDELLPGDLVFFKTGSGESGLHVGIYDTNNEFIHASTSRGVMRSSLDNVYWRKNFWQARRI

SEQ ID NO: 1319 - DNA, 585 bp, Yersinia pestis
  CDS (1)..(585)
atggtcaagtctcaacctattctgagatatattctgcgggcgctccctgcagttgcagcagcagtaatgttatccgcatgcagttcaccacaggcttcgaatgtaaataatacgcaaactgagatgcgtgcagttaatgacaaagatgggcttttactgcaagcctctcaggatgaattcgaagcgatggttcgcaacgttgacatcaagtcaaagattttagaacagtatgcaggttggaaaggtgttcgttatcgtttaggcggtagcagtaaacgcggtattgattgttccgcatttgtacaaaccactttccgtgaacagtttggtatggatttgccgcgctcaacatctcagcagcaggatctcggcaagaaagtccagcggactaaattacgtccaggtgatcttgttctattccgcgcaggctcaacagggcgtcatgtcggtatctatttaggtaacgataaatttgttcatgcatcgaccagtgccggtgtaacgatatcgaacctgaatgacgattactggaataagcgttatcgtgatgggcgtcgagtgctaagtagcagttcgagcagctag

SEQ ID NO: 1320 - protein, 194 aa, Yersinia pestis
MVKSQPILRYILRALPAVAAAVMLSACSSPQASNVNNTQTEMRAVNDKDGLLLQASQDEFEAMVRNVDIKSKILEQYAGWKGVRYRLGGSSKRGIDCSAFVQTTFREQFGMDLPRSTSQQQDLGKKVQRTKLRPGDLVLFRAGSTGRHVGIYLGNDKFVHASTSAGVTISNLNDDYWNKRYRDGRRVLSSSSSS

SEQ ID NO: 1321 - DNA, 618 bp, Pseudomonas aeruginosa
  CDS (1)..(618)
atgcccatgcttaaacgcttagcacccctcgtgcccatgagtttcgttctgctgctggccgcttgcgccagccattcgccggagccgcaggtcgccaaagagccgaccgcagccaagagcagcatcgacgtcgaacgcgacgcgatcgcttggcaggatgttgaggacgaaggggcggacaattcatcggctggtacgcctgcgctggcgtccagcatcctcgagcgcgctttcgaactgatcggtacgccgtaccgtttcggcggtacgacggcgaaaggcttcgattgcagcggcttcgtcggctacctgttccgcgaggaggccggcatcaagctgccgcgctccacccgcgaactcatcgatatggacgtaccgctggtctccaaggacgagctgcagcccggcgacctgctgttcttcaacaaccgtggccgtggtcgcgtcagccacgccggcatctacatcggcgatggccagttcatccattccgccagccgtcgcggcggcggggtgcgggtggacagcctggactccagctactggagcctgagctacatggaagccaagcgggtgctcgaacccggctacaaggatgccctgacgagcaagcgctaa

SEQ ID NO: 1322 - protein, 205 aa, Pseudomonas aeruginosa
MPMLKRLAPLVPMSFVLLLAACASHSPEPQVAKEPTAAKSSIDVERDAIAWQDVEDEGADNSSAGTPALASSILERAFELIGTPYRFGGTTAKGFDCSGFVGYLFREEAGIKLPRSTRELIDMDVPLVSKDELQPGDLLFFNNRGRGRVSHAGIYIGDGQFIHSASRRGGGVRVDSLDSSYWSLSYMEAKRVLEPGYKDALTSKR

SEQ ID NO: 1323 - DNA, 459 bp, Campylobacter jejuni
  CDS (1)..(459)
atgaggcatatttttttcatcatcacgattatattttttataagtggatgtagtttttatcagaatctaaactatcgtcctagttacaacacaaataaagaagcaaggctcaaggttattgcaaatgaatggaaaaaaaccccttatgttttaggtggaactagtaaaaaaggtgctgattgttcaggatttacacagagcgcattagctcagcttaatatacgcatacctcgcactacaaaaactcaattaggttctggaagaaaagtttctaaatcaaaattgcaaacaggagatttggtattttttaagacaggtagagggccaaatggtatgcatgttggtatttatatgagcaagggaaaatttatacatttatctactaaagatggagtaaaagaagtcgagctaaatagttcttattggaaggctcgttatataggagcaagaaggtattaa

SEQ ID NO: 1324 - protein, 152 aa, Campylobacter jejuni
MRHIFFIITIIFFISGCSFYQNLNYRPSYNTNKEARLKVIANEWKKTPYVLGGTSKKGADCSGFTQSALAQLNIRIPRTTKTQLGSGRKVSKSKLQTGDLVFFKTGRGPNGMHVGIYMSKGKFIHLSTKDGVKEVELNSSYWKARYIGARRY

SEQ ID NO: 1325 - DNA, 639 bp, Xylella fastidiosa
  CDS (1)..(639)
atgacagccatgttaagcatggcttgtcgacgggcggtgcgtgctggggcgcactgtgatgagggtggacacgtaaaggcgttcgattatcctgactccatgaataacaagccagttcccattgttttgcggaggacgtccattggtttgatcctcttcatcctccctgcaatgctgattggttgcagtcgcgtgccggtcaaaacacagcccaagcccgcttcagtcaacgtgtggcccctcacaaccccagccaatccagaggcagccaatgaggtcgtgatgcgtgccttgagcttggtcggtactccgtaccgcttcggtggcaacacccctgagagtggattcgactgcagcggtttagtcagctacgtctacagggatgcactcgacctgcgtctaccgcgcacttcctacgagctggccgcagtgcagggtcccaagattgacgctgaacaactgaccactggtgatttggtgttctttgggagtgctcgcagtgtcactcacgtgggtatctacctcagtgaaggtcgcttcgtacatgcccccagcagtggtggcaccgtgcgtttggatcggcttgataccccttactggagggatcattacactggcgcaaaacgtgttttacgctga

SEQ ID NO: 1326 - protein, 212 aa, Xylella fastidiosa
MTAMLSMACRRAVRAGAHCDEGGHVKAFDYPDSMNNKPVPIVLRRTSIGLILFILPAMLIGCSRVPVKTQPKPASVNVWPLTTPANPEAANEVVMRALSLVGTPYRFGGNTPESGFDCSGLVSYVYRDALDLRLPRTSYELAAVQGPKIDAEQLTTGDLVFFGSARSVTHVGIYLSEGRFVHAPSSGGTVRLDRLDTPYWRDHYTGAKRVLR

SEQ ID NO: 1327 - DNA, 534 bp, Pseudomonas aeruginosa
  CDS (1)..(534)
atgcatgcactggcccgattctcgatcctcgcctttgctgcgctgcttaccgcctgcgccagcaaagcgccgccccccgcgcccgccaaacaggtcgtattccgtccggcgacgaatttctcgcccgccgccgacgatgtgctgttccgtgccctcggcctggtcggcacgccctaccgctggggcggcaacacgcccgattcgggcttcgattgcagcggcctgatcaacttcgtctaccgcgacatgaccggcatcaagctgccgcgctcgacccgcgagatgatttccatgcgcgcgcccagcgtgccggtgcaggccctgcagaccggcgacctggtgttcttcgccacctccggtggtcgcaccgtgagccatgccggcatctacgtcggcgagggtcgcttcgtgcatgcgccgcgcaccggcggcacggtgcgcctggacagcctgcagaacagctactggcaacgcgcgtacctggacgccaagcgcgtgctggtcgcgccgtcgccgttggcgcgggtgccctga

SEQ ID NO: 1328 - protein, 177 aa, Pseudomonas aeruginosa
MHALARFSILAFAALLTACASKAPPPAPAKQVVFRPATNFSPAADDVLFRALGLVGTPYRWGGNTPDSGFDCSGLINFVYRDMTGIKLPRSTREMISMRAPSVPVQALQTGDLVFFATSGGRTVSHAGIYVGEGRFVHAPRTGGTVRLDSLQNSYWQRAYLDAKRVLVAPSPLARVP

SEQ ID NO: 1329 - DNA, 501 bp, Vibrio cholerae
  CDS (1)..(501)
atgttgacggtcaagcaaacgttttctctgcttattctaggattccttgtcgggtgtacagccactccgccttccgagcctgatacttctgtatccgaaccgaattcgagtaacctaccattggcgaacttttcgagtgtattcacagagtggcgcggcgtaccctatcgtttaggcgggaatagcaaaaacggcattgattgttcagcttttgtacaaattgcttaccgcgacgcatggcaacgagatttaccgcgcaccacacagtctcaagcgcaaacgggtcagaaaatcgcatatgaacatgctcaatatggggatctggtattttttaagacatcccgcaccaatattcacgtcggtgtctatttaggggataagcagtttatgcacgcttcaacgtcgaaaggcgtgatcatttcgagaatggataacccttactgggcttcaaaattttggcattttaggcggattgagaatccgcctttgttgtcaaactaa

SEQ ID NO: 1330 - protein, 166 aa, Vibrio cholerae
MLTVKQTFSLLILGFLVGCTATPPSEPDTSVSEPNSSNLPLANFSSVFTEWRGVPYRLGGNSKNGIDCSAFVQIAYRDAWQRDLPRTTQSQAQTGQKIAYEHAQYGDLVFFKTSRTNIHVGVYLGDKQFMHASTSKGVIISRMDNPYWASKFWHFRRIENPPLLSN

SEQ ID NO: 1331 - DNA, 597 bp, Pseudomonas aeruginosa
  CDS (1)..(597)
atgcgttcaccctttttgacatgcctgtctgtaggcttcgcggcccttctggccgccctctcgacgcccagcctggcttccaaccaggtcacccacaccttcaagccgtcgaagaattccaccctgtcgcccagccgggtcgtcagcacccgccagtccgccaaccgctcggtggtcgcggccgccgcttccgaagtcaccgaccgcgccttcagcatgatcggcaccccctaccgctggggcggcaccacgccgaagaaaggcttcgattgcagcggcctggtcaactatgtgttccaggacgtcgatgacgtcgacctgccgcggaccgcccgcgccatctacaacatggacaacaacaaggtctcccgcggcaagctgcaaccgggcgacctggtgttcttccggatccgcagccgcagcgtcgaccacgtcggcatctacgtcggcaacgaccgcttcgtgcacgcgccgcggcgcggcaagaaggtccgcgtctccgacctcaacagcagctactggaaacgccactacctggccggcaagcgcatcctgccgaccaccctcgcccaggtcgaaagcacccgcaagcgctga

SEQ ID NO: 1332 - protein, 198 aa, Pseudomonas aeruginosa
MRSPFLTCLSVGFAALLAALSTPSLASNQVTHTFKPSKNSTLSPSRVVSTRQSANRSVVAAAASEVTDRAFSMIGTPYRWGGTTPKKGFDCSGLVNYVFQDVDDVDLPRTARAIYNMDNNKVSRGKLQPGDLVFFRIRSRSVDHVGIYVGNDRFVHAPRRGKKVRVSDLNSSYWKRHYLAGKRILPTTLAQVESTRKR

SEQ ID NO: 1333 - DNA, 567 bp, Escherichia coli
  CDS (1)..(567)
atggtcaaatctcaaccgattttgagatatatcttgcgcgggattcccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgactggaaaggcgtacgttatcgtctgggcggcagcactaaaaaaggtatcgattgttctggtttcgtacagcgtacattccgtgagcaatttggcttagaacttccgcgttcgacttacgaacagcaggaaatgggtaaatctgtttcccgcagtaatttgcgtacgggtgatttagttctgttccgtgccggttcaacgggacgccatgtcggtatttatatcggcaacaatcagtttgtccatgcttccaccagcagtggtgttattatttccagcatgaatgaaccgtactggaagaagcgttacaacgaagcacgccgggttctcagccgcagctaa

SEQ ID NO: 1334 - protein, 188 aa, Escherichia coli
MVKSQPILRYILRGIPAIAVAVLLSACSANNTAKNMHPETRAVGSETSSLQASQDEFENLVRNVDVKSRIMDQYADWKGVRYRLGGSTKKGIDCSGFVQRTFREQFGLELPRSTYEQQEMGKSVSRSNLRTGDLVLFRAGSTGRHVGIYIGNNQFVHASTSSGVIISSMNEPYWKKRYNEARRVLSRS

SEQ ID NO: 1335 - DNA, 486 bp, Haemophilus influenzae
  CDS (1)..(486)
atgaaagtatataaatcatttttaatcgctactgcatcgctgtttttattcgcttgttccagttttcaaaacgatgattatgcgatgaactataaaggtcaaatcggcgaacctattatggccatagccatgttgagcgaacaacaacatgaatgggcaggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaagatattcaaactggcgatttaattttctttaaaactggcagaggccctaatggttatcatgtggggatttatgtaaaagaagataaattccttcatgcttccaccagagggggagtcgtctattcttcaatgaataacccttattggtcgaaagccttctggcaagtcagacggatttaa

SEQ ID NO: 1336 - protein, 161 aa, Haemophilus influenzae
MKVYKSFLIATASLFLFACSSFQNDDYAMNYKGQIGEPIMAIAMLSEQQHEWAGTPYVLGGVSRRGVDCSGFVQKTFFDRFNLRLPRSTVEQANYGKHVRKEDIQTGDLIFFKTGRGPNGYHVGIYVKEDKFLHASTRGGVVYSSMNNPYWSKAFWQVRRI

SEQ ID NO: 1337 - DNA, 552 bp, Haemophilus influenzae
  CDS (1)..(552)
atgttgaaaagaattttagttattattggtttagctgtattagcaaccgcttgttctaatgcaccacgaacggtaagtcatcaggttatttcagaaaatgatgatattcaattaactggtttaattaataatttagaaaaagataatcgaacaggcatttttcacaaagtgagaacaaaccgttcctctgctttgatgggcgataaggctctagccagtgtttataatgaatgggttggcactcgctatcgtatgggcggtacgactaaacgtggtattgattgttcagcatttatgcaaactactttttctgaagtttttggtattgaattgcctcgttctacggctgaacagcgtcatttaggtagaaaaattaataaatcagaacttaaaaaaggcgatttagttttcttccgtaaaaataatcacgttggtgtttatattggtaataaccaatttatgcacgcaagtacagggcaaggcgtgacaataagttcccttgatgaaaaatattgggctagaacctacactcaatcgcgtcgtattatgtaa

SEQ ID NO: 1338 - protein, 183 aa, Haemophilus influenzae
MLKRILVIIGLAVLATACSNAPRTVSHQVISENDDIQLTGLINNLEKDNRTGIFHKVRTNRSSALMGDKALASVYNEWVGTRYRMGGTTKRGIDCSAFMQTTFSEVFGIELPRSTAEQRHLGRKINKSELKKGDLVFFRKNNHVGVYIGNNQFMHASTGQGVTISSLDEKYWARTYTQSRRIM

SEQ ID NO: 1339 - DNA, 486 bp, Haemophilus influenzae
  CDS (1)..(486)
atgaaagtatataaatcatttttaatcgctactgcctcgctgtttttattcgcttggtccagttttcaaaacgatgattatgcgatgaactataaaggtcaaatcggcgatcctattatggccatagccatgttgagcgaacaacaacatgaatgggctcggacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacctttattggtcgaaagccttctggcaagtcagacggatttaa

SEQ ID NO: 1340 - protein, 161 aa, Haemophilus influenzae
MKVYKSFLIATASLFLFAWSSFQNDDYAMNYKGQIGDPIMAIAMLSEQQHEWARTPYVLGGVSRRGVDCSGFVQKTFFDRFNLRLPRSTVEQANYGKHVRKEHIQTGDLIFFKTGRGPNGYHVGIYVKEDKFLHASTRGGVVYSSMNNLYWSKAFWQVRRI

SEQ ID NO: 1341 - DNA, 486 bp, Haemophilus influenzae
  CDS (1)..(486)
atgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacctttattggtcgaaagccttctggcaagtcagacggatttaa

SEQ ID NO: 1342 - protein, 161 aa, Haemophilus influenzae
MKVYKSFLIATASLFLFACSSFQNDDYAMNYKGQIGDPIMAIAMLSEQQHEWAGTPYVLGGVSRRGVDCSGFVQKTFFDRFNLRLPRSTVEQANYGKHVRKEHIQTGDLIFFKTGRGPNGYHVGIYVKEDKFLHASTRGGVVYSSMNNLYWSKAFWQVRRI

SEQ ID NO: 1343 - DNA, 591 bp, Pseudomonas aeruginosa
  CDS (1)..(591): k means g or t/u
atgcgattcaccctttttgacatgcctgtctgtagcttccggcccttctggccccctctcgacgcccaacctggcttccaaccaggtcacccacaccttcaagccgtcgaagaattccacctgtcgctcagccgggtcgtcagcacccgccagttcgccaaccgctcggtggtcgcggccgccgcttccgaagtcaccgaccgckccttcagcatgatcggcaccccctaccgctggggcggcaccacgccgaagaaaggcttcgattgcagcggcctggtcaactatgtgttccaggacgtcgatgacgtcgacctgccgcggaccgcccgckccatctacaacatggacaacaacaaggtctcccgcggcaagctgcaaccgggcgacctggtgttcttccggatccgcagccgcagcgtcgaccacgtcggcatctacgtcggcaacgccgcttcgtgcacgttccgcggcggcaagaaggtccgcgtctccgacctcaacagcagctactggaaacgccactacctggtcggcaagcgcatcctgccgaccaccctcgcccaggtcgaaagcacccgcaagctctga

SEQ ID NO: 1344 - protein, 196 aa, Pseudomonas aeruginosa
  misc_feature (69)..(69): Xaa can be Ala or Ser
  misc_feature (112)..(112): Xaa can be Ala or Ser
MRFTLFDMPVCSFRPFWPPLDAQPGFQPGHPHLQAVEEFHLSLSRVVSTRQFANRSVVAAAASEVTDRXFSMIGTPYRWGGTTPKKGFDCSGLVNYVFQDVDDVDLPRTARXIYNMDNNKVSRGKLQPGDLVFFRIRSRSVDHVGIYVGNAASCTFRGGKKVRVSDLNSSYWKRHYLVGKRILPTTLAQVESTRKL

SEQ ID NO: 1345 - DNA, 468 bp, Vibrio vulnificus (strain YJ016)
  CDS (1)..(468)
atggctcaatgtaaccgattcattatcatatccatttttgcgttgctaagtggttgtagccaaagcctgaaagcgccagagacatcggcagcactttgggagcaaaaccaagagttaaaaacgttttatggcgaatggtatggcacgccctatcagtttggtgggaatactaaaaaagggattgattgctctgcttttgtacaacaagcgtttctccacgcctatcaacgagcactaccaagaacgaccttggcacagtttaatgcttcccaaccgatacgttgggaagagaggcaacaaggcgatctactattcttcaaaacaacaaaatccgattatcacgtggggatctatctcaaccaccagcagttcatgcatgcgtccacttcaaaaggggtcatcatttcgagaaccgataatccatattgggcgagtaaattttggcaaataagaagggttacaatgtaa

SEQ ID NO: 1346 - protein, 155 aa, Vibrio vulnificus (strain YJ016)
MAQCNRFIIISIFALLSGCSQSLKAPETSAALWEQNQELKTFYGEWYGTPYQFGGNTKKGIDCSAFVQQAFLHAYQRALPRTTLAQFNASQPIRWEERQQGDLLFFKTTKSDYHVGIYLNHQQFMHASTSKGVIISRTDNPYWASKFWQIRRVTM

SEQ ID NO: 1347 - DNA, 591 bp, Photorhabdus luminescens (subsp. laumondii)
  CDS (1)..(591)
atggtcaagtctcaaccggcactgagatacattacgcggctgatacccgcgctgttcgtagcgatcaccttatccgcgtgcagctcaccagattcatcaaggtttcgtaacacacaaactgatacgcatgcagtaaacggtaagaacggcttcttacttcaagcgtctcaggatgaattcgaagcactcgttcgcaatctggacataaaatctaaaattcttagccaatacaatggctggaaaggggttgcctatcgactcggtggcgttactaaacgcggtatagattgttctggctttgttcaacgtactttccgtgaccagtttggtatggaactgccgcgttcaacatttgaacaacagaatattggcaaaaaaattgaccgttcaagattacgccctggcgatttagttttatttaagacaggtgcccgtaccaggcatattggcatctatgttggcaatgaccaatttgttcacgcctctactagcaatggtgtaatcgtttccagattaagcagcacatactggagcaaacgttattatagcggtcgccgagtcatcagtaatagcattgtgcctaatggctaa

SEQ ID NO: 1348 - protein, 196 aa, Photorhabdus luminescens (subsp. laumondii)
MVKSQPALRYITRLIPALFVAITLSACSSPDSSRFRNTQTDTHAVNGKNGFLLQASQDEFEALVRNLDIKSKILSQYNGWKGVAYRLGGVTKRGIDCSGFVQRTFRDQFGMELPRSTFEQQNIGKKIDRSRLRPGDLVLFKTGARTRHIGIYVGNDQFVHASTSNGVIVSRLSSTYWSKRYYSGRRVISNSIVPNG

SEQ ID NO: 1349 - DNA, 486 bp, Photorhabdus luminescens (subsp. laumondii)
  CDS (1)..(486)
atgataataagaataaaagagttactcttattgttcagtctgttacttattggctgttccagtcatgcccccaggactccggctcctgtgttaaagacggcgctttctgatccaatcatggtgattgctcagcttaaggagcagcttaatcaatggcgtggtacaccatatcattatggtggaatggatcgccggggggtagattgttctggttttgtttaccgtactttcagtgatcggtttgatattcaattacctcgtactaccggtgggcaaataaaattagggacccgtattgataaaagcgatttaatgccgggtgatttggtctttttcagaacagctagtggcgaacatgggttacatgttggcatttatgacgccaataaccagtttattcatgcatcaacccataaaggtgttactcgttcatctatgaataatgtttactggaagaaagctttttggcaagcccggagaatttaa

SEQ ID NO: 1350 - protein, 161 aa, Photorhabdus luminescens (subsp. laumondii)
MIIRIKELLLLFSLLLIGCSSHAPRTPAPVLKTALSDPIMVIAQLKEQLNQWRGTPYHYGGMDRRGVDCSGFVYRTFSDRFDIQLPRTTGGQIKLGTRIDKSDLMPGDLVFFRTASGEHGLHVGIYDANNQFIHASTHKGVTRSSMNNVYWKKAFWQARRI

SEQ ID NO: 1351 - DNA, 516 bp, Haemophilus ducreyi
  CDS (1)..(516)
atgcgtaaatttaataaaaaaatatttcctttgttagcactattgagcagtgtatttatattatctgcttgctctaatagtgggtatgaaaatagtgcatcacataaaatcgctaagaaccagcatattagcttatctgattcacaagcggttattagacaattagctcagcaacaaaaagaatggcaaggtactcgttatcgattaggtggtaataataaagcgggggttgattgttccggctttatgcaagttacatttcgtaggctatttaatattgatttgccacgcactacaacagatcagctaaaaaaaggtaacaagattgctcgtaataaaatcaaagccggtgatttagtcttttttaaaaccggtcgtggaccgaatggtaaacatgttggcgtttatgtaaaagatgggaagtttttacacgcttcaactaaaggtggagtaatttactcaaatattgactcaccttattggcgtaaagcattttggcaagcccgtcggttataa

SEQ ID NO: 1352 - protein, 171 aa, Haemophilus ducreyi
MRKFNKKIFPLLALLSSVFILSACSNSGYENSASHKIAKNQHISLSDSQAVIRQLAQQQKEWQGTRYRLGGNNKAGVDCSGFMQVTFRRLFNIDLPRTTTDQLKKGNKIARNKIKAGDLVFFKTGRGPNGKHVGVYVKDGKFLHASTKGGVIYSNIDSPYWRKAFWQARRL

SEQ ID NO: 1353 - DNA, 660 bp, Bordetella pertussis
  CDS (1)..(660)
atgcatcgacactccaaccccgcgctacctgaacgcaatatcagcctgtcgagccgcggtctgcgcttgctggcggtggtagcgtgcgcggtgggactggccggttgcgccggcaccggtgccaagaaaacgtcgtataccttcgaaagcgacccctacgacaccgagtgggtcgccagcgccgacgatccgataggcatcctggtcacccagaagctcaagcgcgaccggcgcgccggccagtcgcagaccagcggcgagaacccgctggtcagcgaagcgctgggccagcttggcgtgcgctaccggttcgacggcatctcgcccgataccggcttcgattgcagcggcctggtggcccataccgccgagcgctcgctgggcctgaaactgccgcgcatctcggccgacatcgcccgctggggcaccaacatcgaccgcaaggaattgcgcccgggcgacctggtgttcttcaacaccctgggccggcgctactcgcatgtcggcatctacatgggcgaaaaccgcttcatccactcgcccagctccggcggcgtggtgcgtgtcgaaaacatgaccgtggcctactgggccaagcgctacaacggcgcgcgccgcatcgacgacagccgccttgcctcggcgcgcgcgtcgaactga

SEQ ID NO: 1354 - protein, 219 aa, Bordetella pertussis
MHRHSNPALPERNISLSSRGLRLLAVVACAVGLAGCAGTGAKKTSYTFESDPYDTEWVASADDPIGILVTQKLKRDRRAGQSQTSGENPLVSEALGQLGVRYRFDGISPDTGFDCSGLVAHTAERSLGLKLPRISADIARWGTNIDRKELRPGDLVFFNTLGRRYSHVGIYMGENRFIHSPSSGGVVRVENMTVAYWAKRYNGARRIDDSRLASARASN

SEQ ID NO: 1355 - DNA, 669 bp, Bordetella parapertussis
  CDS (1)..(669)
atgcggcgaatgcatcgacactccaaccccgcgctacctgaacgcaatatcagcctgtcgagccgcggtctgcgcttgctggcggtggtagcgtgcgcggtgggactggccggttgcgccggcaccggtgccaagaaaacgtcgtataccttcgaaagcgatccctacgacaccgagtgggtcgccagcgccgacgatccgataggcatcctggtcacccagaagctcaagcgcgaccggcgcgccggccagtcgcagaccagcggcgagaacccgctggtcagcgaagcgctgggccagcttggcgtgcgttaccggttcggcggcatctcgcccgataccggcttcgattgcagcggcctggtggcctataccgccgagcgctcgctgggcttgaaactgccgcgcatctcggccgacatcgcccgctggggcaccaatatcgaccgcaaggaattgcgcccgggcgacctggtgttcttcaacgccctgggccggcgctactcgcatgtcggcatctacatgggcgaaaaccgcttcatccactcgcccagctccggcggcgtggtgcgtgtcgagaacatgaccgtggcctactgggccaagcgctacaacggcgcgcgccgcatcgacgacagccgcctcgcctcggcgcgcgcgtcgaactga

SEQ ID NO: 1356 - protein, 222 aa, Bordetella parapertussis
MRRMHRHSNPALPERNISLSSRGLRLLAVVACAVGLAGCAGTGAKKTSYTFESDPYDTEWVASADDPIGILVTQKLKRDRRAGQSQTSGENPLVSEALGQLGVRYRFGGISPDTGFDCSGLVAYTAERSLGLKLPRISADIARWGTNIDRKELRPGDLVFFNALGRRYSHVGIYMGENRFIHSPSSGGVVRVENMTVAYWAKRYNGARRIDDSRLASARASN

SEQ ID NO: 1357 - DNA, 669 bp, Bordetella bronchiseptica (Alcaligenes bronchisepticus)
  CDS (1)..(669)
atgcggcgaatgcatcgacactccaaccccgcgctacctgaacgcaatatcagcctgtcgagccgcggtctgcgcttgctggcggtggtagcgtgcgcggtgggactggccggttgcgccggcaccggtgccaagaaaacgtcgtataccttcgaaagcgatccctacgacaccgagtgggtcgccagcgccgacgatccgataggcatcctggtcacccagaagctcaagcgcgaccggcgcgccggccagtcgcagaccagcggcgagaacccgctggtcagcgaagcgctgggccagcttggcgtgcgttaccggttcggcggcatctcgcccgataccggcttcgattgcagcggcctggtggcctataccgccgagcgctcgctgggcttgaaactgccgcgcatctcggccgacatcgcccgctggggcaccaatatcgaccgcaaggaattgcgcccgggcgacctggtgttcttcaacaccctgggccggcgctactcgcatgtcggcatctacatgggcgaaaaccgcttcatccactcgcccagctccggcggcgtggtgcgtgtcgagaacatgaccgtggcctactgggccaagcgctacaacggcgcgcgccgcatcgacgacagccgcctcgcctcggcgcgcgcgtcgaactga

SEQ ID NO: 1358 - protein, 222 aa, Bordetella bronchiseptica (Alcaligenes bronchisepticus)
MRRMHRHSNPALPERNISLSSRGLRLLAVVACAVGLAGCAGTGAKKTSYTFESDPYDTEWVASADDPIGILVTQKLKRDRRAGQSQTSGENPLVSEALGQLGVRYRFGGISPDTGFDCSGLVAYTAERSLGLKLPRISADIARWGTNIDRKELRPGDLVFFNTLGRRYSHVGIYMGENRFIHSPSSGGVVRVENMTVAYWAKRYNGARRIDDSRLASARASN

SEQ ID NO: 1359 - DNA, 525 bp, Nitrosomonas europaea
  CDS (1)..(525)
atgtccttaaaacacattgtcattctgttgctcggcactggcatggtggtgggatgcagttctgtcccgaaagattcaaatcaggaaaaagtttcacgtcattggcataaacccgcgtttgttactcccgataaaacaacggaaaacaatccgtattcgtacttcgtgcgagatcgtctgtacagccaatatgaggagtggcgtggtgttcgctatcgactgggtgggtcggatcattcaggaatagattgttcagcatttgtcaaaattatctatgaagcagagttcggcctctcattacccagaactgcactttcgcaggcaaaccttggcagtgaaatcaaccagaacaaactgatgccgggcgatctggtatttttcaaaacaggcagatattcacagcacgtgggaatttatctcgacagcagacaattccttcatgtctcgacccgtaaaggcgtgaccatatcccaactggataatacttactggaaatccagatactggaaggccgtcaggatctaa

SEQ ID NO: 1360 - protein, 174 aa, Nitrosomonas europaea
MSLKHIVILLLGTGMVVGCSSVPKDSNQEKVSRHWHKPAFVTPDKTTENNPYSYFVRDRLYSQYEEWRGVRYRLGGSDHSGIDCSAFVKIIYEAEFGLSLPRTALSQANLGSEINQNKLMPGDLVFFKTGRYSQHVGIYLDSRQFLHVSTRKGVTISQLDNTYWKSRYWKAVRI

SEQ ID NO: 1361 - DNA, 465 bp, Shigella flexneri
  CDS (1)..(465)
atgcgtttctgccttattttgatcacagcactgtttctggccgggtgtagccaccataaagcaccgccgccaaatgccagactttctgattcgattaccgttattgccggtttgaacgaccagctacaaagctggcatggcacgccgtatcgttatggtggcatgacgcggcgcggtgtggactgttcgggatttgtggttgtgacgatgcgcgatcgtttcgatttgcatctgccccgtgaaaccaaacaacaagcctctattggcacgcaaattgataaagacgagttgctgcctggtgacctggtctttttcaaaacgggttccggacaaaatggtttgcatgtaggtatttacgataccaacaaccaatttatccacgcctctaccagcaagggagtgatgcgttcctcacttgataatgtctattggcagaaaaatttctggcaggcgagacgaatctag

SEQ ID NO: 1362 - protein, 154 aa, Shigella flexneri
MRFCLILITALFLAGCSHHKAPPPNARLSDSITVIAGLNDQLQSWHGTPYRYGGMTRRGVDCSGFVVVTMRDRFDLHLPRETKQQASIGTQIDKDELLPGDLVFFKTGSGQNGLHVGIYDTNNQFIHASTSKGVMRSSLDNVYWQKNFWQARRI

SEQ ID NO: 1363 - DNA, 639 bp, Xylella fastidiosa (strain Temecula1 / ATCC 700964)
  CDS (1)..(639)
atgacagccatgttaagcatggcttgtcgacgggcggtgcgtactggggcgcactgtgatgagggtggaaacgtaaaggcgttcgattatcctgactccatgaataacaagccagttcccattgttttgcggaggacgtccattggttcgatcctcttcatcctccctgcaatgctgattggttgcagtcgcgtgccggtcaaaacacagcccaagctcgcttcagtcaacgtgtggcccctcacaaccccagccaatccagaggcagccaatgaggtcgtgatgcgtgccttgagcttggttggcactccgtaccgcttcggtggcaacacccctgagagtggattcgactgcagcggtttagtcagctacgtctaccgcgatgcactcgacttgcgtctaccgcgcacttcctacgagctggccgcagtgcagggtcccaagattgacgctgaacaactgaccactggtgatttggtgttctttgggagtgcccgtagtgtcactcacgtgggcatctacctcagtgaaggtcgcttcgtacatgcccccagcagtggtggcaccgtgcgtttggatcggcttgataccccttactggagggatcattacactggcgcaaaacgtgttttacgctga

SEQ ID NO: 1364 - protein, 212 aa, Xylella fastidiosa (strain Temecula1 / ATCC 700964)
MTAMLSMACRRAVRTGAHCDEGGNVKAFDYPDSMNNKPVPIVLRRTSIGSILFILPAMLIGCSRVPVKTQPKLASVNVWPLTTPANPEAANEVVMRALSLVGTPYRFGGNTPESGFDCSGLVSYVYRDALDLRLPRTSYELAAVQGPKIDAEQLTTGDLVFFGSARSVTHVGIYLSEGRFVHAPSSGGTVRLDRLDTPYWRDHYTGAKRVLR

SEQ ID NO: 1365 - DNA, 480 bp, Vibrio parahaemolyticus
  CDS (1)..(480)
atgcgtcgtatatattttcctttgataatcagtgctctactttcagcttgttcgtctggcccagagccgagtgagcaggttgaagtaactgtacccaccaatcagttattgtctaataaccctgacttgtttcggttttacaacgagtggcacggcacgccctatcgacttggtggaacacaaaaatctggaatcgactgttcggctttcgttcaaagagcctttgtcgaagcgtatcaactcgccctaccaaggacgacaaagcagcaatccacacaaggcgttgagctgagttggacggatgccaaacaaggagatttggtgttttttaaaactcgacgaagcacctaccacgttggaatctacttggggaacaagcagtttatgcacgcatcaacgtctaaaggggtaattatctctagaatcgacaacccttactgggcgtccaagttttggcaagtaagaagagttaccttgtaa

SEQ ID NO: 1366 - protein, 159 aa, Vibrio parahaemolyticus
MRRIYFPLIISALLSACSSGPEPSEQVEVTVPTNQLLSNNPDLFRFYNEWHGTPYRLGGTQKSGIDCSAFVQRAFVEAYQLALPRTTKQQSTQGVELSWTDAKQGDLVFFKTRRSTYHVGIYLGNKQFMHASTSKGVIISRIDNPYWASKFWQVRRVTL

SEQ ID NO: 1367 - DNA, 681 bp, Pseudomonas syringae (pv. tomato)
  CDS (1)..(681)
atgcgtcctcttttcaagacatggctaaccatttgcctatttatgccactggccgcccacgccaccaatcgtgagcaacaacttcctgcgagcttcacgggctacaccgccaaaagtcactcttcaccggcactcgcgactcgcaatgcaccccaggaagccacaccagtctctctgcaacctaaaacctctcacgccactcagaagccactttcccgcaaaaacgccaaggccgccgccttgcaggcgtccatcgccgcgcctgccaaacagggcaatgccgttgtaaaacgcgccttacaggctgtcggtacaccgtatcgctggggcggcaccacgcccggcaaaggtctggactgcagcgggctggtcaaatatgcctacaccgatgttcgtgaagtcgacctgccgcgcacgtccaacgcaatggctcagggtcatggccagaccgtggaccgcaaggacctgaagccaggtgacctgctgttcttcaacatcaagagccgcaacatcaatcatgtggctatctacctgggcgacaacaagttcgtccacgcgccacgacgtggcaaggcggtcactgtcgacacgctgaacaagccgtactggaacagtcactacaagatcgccaagcgcgtgctgcccaagcaggcacagcagttgcgcgtcgttcagcgctga

SEQ ID NO: 1368 - protein, 226 aa, Pseudomonas syringae (pv. tomato)
MRPLFKTWLTICLFMPLAAHATNREQQLPASFTGYTAKSHSSPALATRNAPQEATPVSLQPKTSHATQKPLSRKNAKAAALQASIAAPAKQGNAVVKRALQAVGTPYRWGGTTPGKGLDCSGLVKYAYTDVREVDLPRTSNAMAQGHGQTVDRKDLKPGDLLFFNIKSRNINHVAIYLGDNKFVHAPRRGKAVTVDTLNKPYWNSHYKIAKRVLPKQAQQLRVVQR

SEQ ID NO: 1369 - DNA, 546 bp, Pseudomonas syringae (pv. tomato)
  CDS (1)..(546)
atgtcgattgttttgcgcctgatggtcatctgtgttgccgcgttgctgggcgcttgtgccagcgcgccgccaccgcccaaagtaccccggattgttcagcgtccggtggtcaccgctccccctcagattctttctccggctgccgaagacgtgctgtttcgtgcgttgggcctggtcggcacgccctatcgctggggcggcaacacgccagattccggtttcgattgtagcggccttataggctatgtctatcgtgatgcggcgggcatttccctgccacgttccacccgcgagatgatcgtgatgggtgtgccgaatattcgtcgcgagcagttgcagtcgggtgacctggtatttttcgccacctcgggcggttcgcaagtgtcccacgcgggcatctacgtcggcgaaggccgcttcgtgcatgcccccgccaccggcggcacagtcaaactcgacagcctcgacaagccttactggcagaaagcctacctcaacgccaagcgcgtgattcagccagcaagcctggcgcagattcgaccgtag

SEQ ID NO: 1370 - protein, 181 aa, Pseudomonas syringae (pv. tomato)
MSIVLRLMVICVAALLGACASAPPPPKVPRIVQRPVVTAPPQILSPAAEDVLFRALGLVGTPYRWGGNTPDSGFDCSGLIGYVYRDAAGISLPRSTREMIVMGVPNIRREQLQSGDLVFFATSGGSQVSHAGIYVGEGRFVHAPATGGTVKLDSLDKPYWQKAYLNAKRVIQPASLAQIRP

SEQ ID NO: 1371 - DNA, 624 bp, Pseudomonas putida (strain KT2440)
  CDS (1)..(624)
atgccgcctttgatcaagacatggctgaccctctgcctattattgcccctggccgcccacgccaccaatcgtgagcaacgtcttcccaatggtttcaccggctatacgaccaacgcctcggtgaaacgcgcaccagtcaaacagaccgcgctacgcgcccgcccaggcaatgccgccagcagccgcggtgcgaatgtcgccgccatgtcgcctaagcaaagcagcgatgtgctgagccgtgcggtaaatgtgctcggtactccttatgtttggggcggcagcagcccgaaaaaaggctttgactgcagcgggctggtcaaatacgccttcaacgacgtcgccgacgtcgacctgccgcgcacctccaatgccatggcccggggccacggggtgaaggtggccaagggtgatctgaagcctggcgacctgatcttcttcaacatcaagagccgtcgggtcaatcacgtagccatctacctgggtaacgaccgcttcatccacgctccacgccgtggcaagcgggtgagtatcgacaccttgagcaagccttactggcagaagcactacgtggtggccaagcgggtgctgccgaaagagcagcagctgagtctggccaagcgttaa

SEQ ID NO: 1372 - protein, 207 aa, Pseudomonas putida (strain KT2440)
MPPLIKTWLTLCLLLPLAAHATNREQRLPNGFTGYTTNASVKRAPVKQTALRARPGNAASSRGANVAAMSPKQSSDVLSRAVNVLGTPYVWGGSSPKKGFDCSGLVKYAFNDVADVDLPRTSNAMARGHGVKVAKGDLKPGDLIFFNIKSRRVNHVAIYLGNDRFIHAPRRGKRVSIDTLSKPYWQKHYVVAKRVLPKEQQLSLAKR

SEQ ID NO: 1373 - DNA, 534 bp, Pseudomonas putida (strain KT2440)
  CDS (1)..(534)
atggtaaagatggcgcgcttcgcatttctctccttggcagccttgctggctgcatgctccagccgtgcgcctgcgccggcccctgtggtacagccgcaggttacctatagccagcccagtccttcaccgattgccgatgacgtgctgattcgcgccattggtctggttggcacgccctatcgttgggggggcaataccccggactccggcttcgattgcagcggcctgatcaagtatgtgtaccgtgatgctgctggcatcagtctgccgcgctcgacgcgagagatgattgtcatgcgcgcacccacggtggatgccagttcgctgcagtccggtgacctggtgttcttcgccaccagtggcggctcgcaggtcagccatgccggcatctatgtcggggacgggcgcttcgtgcatgcaccttccaccggtggcaccgtgcgcctggactacctgtcgaacagctactgggccaaggcctacctgcaggccaagcgggtgattccgcaagggcatctggcacagaacccttga

SEQ ID NO: 1374 - protein, 177 aa, Pseudomonas putida (strain KT2440)
MVKMARFAFLSLAALLAACSSRAPAPAPVVQPQVTYSQPSPSPIADDVLIRAIGLVGTPYRWGGNTPDSGFDCSGLIKYVYRDAAGISLPRSTREMIVMRAPTVDASSLQSGDLVFFATSGGSQVSHAGIYVGDGRFVHAPSTGGTVRLDYLSNSYWAKAYLQAKRVIPQGHLAQNP

SEQ ID NO: 1375 - DNA, 645 bp, Pseudomonas putida (strain KT2440)
  CDS (1)..(645)
atgcccatgctgaagcgcttcgcacccctcgtgccactcgcactcgtgaccctgctttttggctgcgcggcccaaggcccggtatctcagccccaggatcacaccccgatcactgcccaatcggcaatcaacgccaaagcctcttcctcgtcggtattcggcgagccggaagagctggccaccgaagatgacctggcgtctttctccggcggcaagccttaccaattgccggttctggctgacagcattctcgagcgcggtatgtcgttgatcggcactcgctaccgctttggtggtacctcggaaaagtctggcttcgactgcagtggcttcatcggttacctgttccgcgaagaggcgggcatgacgctgccgcgctccacgcgtgaaatgatcaacgtcgatgcgccgaaagtggcccgcaacaagctcaagccaggtgacttgctgttcttcagcaccaatggccgcggccgggtaagccatgccggcatctacctgggtgacaaccagttcatccactccagcagccgccgcagtggtggtgtgcgcatcgacagcctcggtgatcgctactggagcaagaccttcattgaagccaagcgcgccttggccatggcgccgaccaacatcgcgcgcaactga

SEQ ID NO: 1376 - protein, 214 aa, Pseudomonas putida (strain KT2440)
MPMLKRFAPLVPLALVTLLFGCAAQGPVSQPQDHTPITAQSAINAKASSSSVFGEPEELATEDDLASFSGGKPYQLPVLADSILERGMSLIGTRYRFGGTSEKSGFDCSGFIGYLFREEAGMTLPRSTREMINVDAPKVARNKLKPGDLLFFSTNGRGRVSHAGIYLGDNQFIHSSSRRSGGVRIDSLGDRYWSKTFIEAKRALAMAPTNIARN

SEQ ID NO: 1377 - DNA, 609 bp, Clostridium tetani
  CDS (1)..(609)
atggaaaaaatgaataataaaaaaacgaaaaacttattaatttctatggttatgttctgtgctattttgtttggattaaacaaggtaaacattgtaaaagcagatgcaccaataagaacaaccaattctcttagtaaaaaagtagtaacagcaaatgtaaagaccaataaatgcatagttgtacctaaaaaagatacaggttcattacaaagtaaaaatggagattctttaagtagaggaagttctagaggtgtggatttagtatcttattcttatcaattcatgggaaagccttatgtatggggagcttcaggaccaaattcttttgactgttcaggttttactgcctatgtatacaaaaactttggagtgaatttagatcattacacaggttcacagtatgaagaaggaaaaccagtaagcaaatctgaattaatccctggagatttaatattttttaatactaccagcagtatttcacatgtaggtatttatgtaggaggagggcaatttatacatgcatcctctggtggtggaaaagttatagtaagtgatttatctggtagttattatgtaagtaggtatgctggtgctaggagaatgttttag

SEQ ID NO: 1378 - protein, 202 aa, Clostridium tetani
MEKMNNKKTKNLLISMVMFCAILFGLNKVNIVKADAPIRTTNSLSKKVVTANVKTNKCIVVPKKDTGSLQSKNGDSLSRGSSRGVDLVSYSYQFMGKPYVWGASGPNSFDCSGFTAYVYKNFGVNLDHYTGSQYEEGKPVSKSELIPGDLIFFNTTSSISHVGIYVGGGQFIHASSGGGKVIVSDLSGSYYVSRYAGARRMF

SEQ ID NO: 1379 - DNA, 513 bp, Bacteroides thetaiotaomicron
  CDS (1)..(513)
atgggagtgaacttcaaactaatcttcatactgacaggactgatctttatccttagttcctgccgcacgtctgctccccgtctggattaccaggcactggcacgcgcctccatcctgctgggcgtggacatcaatatggaagataaccacaaactctatctggaatcggccgaatggattggtgttccttatcgtggaggcggtgattcaaaacgcggtaccgactgttcgggactcacctaccagatataccggaaagtataccgtactcaggttccgcgaaataccgaagacctgagaaaagaaagtaccaaagtcgccaaacggaatttgcgagaaggcgatctggtattcttcagcagtagccgttcccgaaaaaaggtagctcacgtaggtatctatctcaaaaatgggaaattcattcatgccagtaccagcaaaggagtgattgtcagtcgactgagcgaagactattacaccagacactggatatccggaggaagaatacgctga

SEQ ID NO: 1380 - protein, 170 aa, Bacteroides thetaiotaomicron
MGVNFKLIFILTGLIFILSSCRTSAPRLDYQALARASILLGVDINMEDNHKLYLESAEWIGVPYRGGGDSKRGTDCSGLTYQIYRKVYRTQVPRNTEDLRKESTKVAKRNLREGDLVFFSSSRSRKKVAHVGIYLKNGKFIHASTSKGVIVSRLSEDYYTRHWISGGRIR

SEQ ID NO: 1381 - DNA, 465 bp, Escherichia coli O6
  CDS (1)..(465)
atgcgtttctgccttattttgatcacagcactgtttctggccgggtgtagccaccataaagcaccgccgccaaatgccagactttctgattcgattaccgttattgccggtttgaacgaccagctacaaagctggcatggcacgccgtatcgttatggtggcatgacgcggcgcggtgtggactgttcgggatttgtggttgtgacgatgcgcgatcgtttcgatttgcagctgccccgtgaaaccaagcaacaagcctctattggcacgcaaattgataaagacgagttgctgccaggtgacctggtctttttcaaaacgggttccggacaaaatggtttgcatgtaggtatttacgataccaacaaccaatttatccacgcctctaccagcaagggagtgatgcgttcctcacttgataatgtctattggcagaaaaatttctggcaggcgagacgaatctag

SEQ ID NO: 1382 - protein, 154 aa, Escherichia coli O6
MRFCLILITALFLAGCSHHKAPPPNARLSDSITVIAGLNDQLQSWHGTPYRYGGMTRRGVDCSGFVVVTMRDRFDLQLPRETKQQASIGTQIDKDELLPGDLVFFKTGSGQNGLHVGIYDTNNQFIHASTSKGVMRSSLDNVYWQKNFWQARRI

SEQ ID NO: 1383 - DNA, 429 bp, Vibrio vulnificus
  CDS (1)..(429)
atgttgctaagtggttgtagccaaagcccgaaagcgccagagacatcagcagcactttgggaacaaaaccgagagctaaaaacgttttatggcgaatggtatggcacgccctatcagtttggtgggaatactaaagaagggattgattgctctgcttttgtacaacaagcgtttctctacgcctatcaacgagcgctaccaagaacgaccttggcacagtttaatgcttcccaaccgatacgttgggaagagaggcaacaaggcgatctactattcttcaaaacaacgaaatccgattatcacgtggggatctatctcaaccaccagcagttcatgcacgcgtccacttcaaaaggggtcatcatttcgagaacggataatccatattgggcgagtaagttttggcaaataagaagggttacaatgtaa

SEQ ID NO: 1384 - protein, 142 aa, Vibrio vulnificus
MLLSGCSQSPKAPETSAALWEQNRELKTFYGEWYGTPYQFGGNTKEGIDCSAFVQQAFLYAYQRALPRTTLAQFNASQPIRWEERQQGDLLFFKTTKSDYHVGIYLNHQQFMHASTSKGVIISRTDNPYWASKFWQIRRVTM

SEQ ID NO: 1385 - DNA, 465 bp, Shewanella oneidensis
  CDS (1)..(465)
atgaagaaattattaatcgttatcttagccttaggtcttggcgcctgtgctagcgcgccagaacctaagcctgtggtaaagcaagttgaacctgtctctgtgtggaatgatagcaatatcgctgatctgcattccgaatggcgcggcgtgccctatcgcttagggggcgctactaaaaaaggcattgattgctcagcctttgtttctgtggcctatcaaaaaatgttgggcatgacactgccgcgcactgttcaagaacaacaggcgcttggtaaacctgtggcgcgggataagctgcgtaaaggtgatttagtattttttaaaaccggctggagtacgcatcatgtgggcatttatgtgggcgaaaataattttctccatgtttccacgagccaaggggtgaagatttcgagcctgcttaatagctattgggcatctaagtattggaatgctaggcgaatttaa

SEQ ID NO: 1386 - protein, 154 aa, Shewanella oneidensis
MKKLLIVILALGLGACASAPEPKPVVKQVEPVSVWNDSNIADLHSEWRGVPYRLGGATKKGIDCSAFVSVAYQKMLGMTLPRTVQEQQALGKPVARDKLRKGDLVFFKTGWSTHHVGIYVGENNFLHVSTSQGVKISSLLNSYWASKYWNARRI

SEQ ID NO: 1387 - DNA, 618 bp, Chlorobium tepidum
  CDS (1)..(618)
atgcctatgcgaaaagagcagcaatcccgtccagaccttcgggttctgaaaagtctcatggtttgcgccaccattgcggcctctttgattctccactccccctcgctcatggctgccgaagaggcaaccggagcaaccagcaccgcgccgtcagcctgtagtatcaatccatcagaaaaactcaagaatcttttcaccgaagtcaagcagtaccttggcatccgttaccgtttcggcggagacacgccgtcaggtttcgattgttcgggctttgtcaggttcatgttcaataaagaattcaacgtcaatctgcctcgctcgtcacgtgaaatggcaacgataggcacaagaatagatcgcaacgaactccggcccggcgacctcgtatttttcaagaacgcagaagaccgcatcaaccacgtaggcattttcgtcggtaacgacaccttcgttcactcctccctctcaaaaggcatcacccgcgacacccttaacgaaagctactacagcaaacgcttcgccaccggtgtccgcattcttgacattcagggcaatcgtattcctgacgacttcaacaacctgttcgacgaatcaaacaacggcaactccccctcctga

SEQ ID NO: 1388 - protein, 205 aa, Chlorobium tepidum
MPMRKEQQSRPDLRVLKSLMVCATIAASLILHSPSLMAAEEATGATSTAPSACSINPSEKLKNLFTEVKQYLGIRYRFGGDTPSGFDCSGFVRFMFNKEFNVNLPRSSREMATIGTRIDRNELRPGDLVFFKNAEDRINHVGIFVGNDTFVHSSLSKGITRDTLNESYYSKRFATGVRILDIQGNRIPDDFNNLFDESNNGNSPS

SEQ ID NO: 1389 - DNA, 648 bp, Chlorobium tepidum
  CDS (1)..(648)
atgaatccggaacaccggaaatccagtttcaccggccccatgaacgagatcacccggttcgctccgaaagccgcaaaagcgacaagcatactcagagcactggcgctcatggtgctcgcgtccctgatgcttacgcttggcgcatgccagagcatacggccactctccgatcgcatggagagcaaatatagtttaaaaaagagaaaaacttctatctcacgcctccgtcctcaaggcccggaacggtgcagtgtgccggtacaggtttccgcacgggccttcagggcgatgctcgattctatcgaagaggccagaggagtgaaatatcgctttggcggaaccacgccggaaggattcgactgctccggcttcgtgcaatatctctacaaccgttcgttccagatgatcttgccccgtgcctcgaatgatctcgcactggtgggcccgatcattcacagagatcgcctgcaacccggtgacctggtctttttcgccgccggggacgagattacccacgtcggagtctacctcggtaacgaacgcttcgcccacgcatcttcaaaagcaggcatcagcatcagcacgctttcccagagctattacgccacccatttcgctttcggcacgaggatcatccgggttgagtag

SEQ ID NO: 1390 - protein, 215 aa, Chlorobium tepidum
MNPEHRKSSFTGPMNEITRFAPKAAKATSILRALALMVLASLMLTLGACQSIRPLSDRMESKYSLKKRKTSISRLRPQGPERCSVPVQVSARAFRAMLDSIEEARGVKYRFGGTTPEGFDCSGFVQYLYNRSFQMILPRASNDLALVGPIIHRDRLQPGDLVFFAAGDEITHVGVYLGNERFAHASSKAGISISTLSQSYYATHFAFGTRIIRVE

SEQ ID NO: 1391 - DNA, 576 bp, Xanthomonas campestris (pv. campestris)
  CDS (1)..(576)
atggcgaccttcgtaaccgcccattatcccggctcgatgcctatcacgccagttgctgccgttcgtccccgcaccgccgcggcctgcctgatgctgggtctgtcgctgctggccgcctgctcgcaggcacccgtacgccgcccggcgccagcacctgccaccgcacgcgtctggcctcaggtaccgccggccaaccccgctgccgccaacaacatcctcatgcgcgccctgggcctggtcggcacgccgtaccggtatggcggcaacacgccggagagcggcttcgactgcagcgggcttgtcacctatgtctacaaagacgtgctggcgctctcattgcccaggacctcgcgtgacctggccgccgtgcaggggccaaaaattccagcggaaaaattgtcaactggcgatctggtcttttttggctccagtggaagcgtgagccacgtcggcatttacgtcggtgaaggccgcttcgtgcacgccccaagcagcggcggtaccgtccgcttggatttcctcgacggggcttactggcgtgaccattattcaggttcaaagcgggttttacattga

SEQ ID NO: 1392 - protein, 191 aa, Xanthomonas campestris (pv. campestris)
MATFVTAHYPGSMPITPVAAVRPRTAAACLMLGLSLLAACSQAPVRRPAPAPATARVWPQVPPANPAAANNILMRALGLVGTPYRYGGNTPESGFDCSGLVTYVYKDVLALSLPRTSRDLAAVQGPKIPAEKLSTGDLVFFGSSGSVSHVGIYVGEGRFVHAPSSGGTVRLDFLDGAYWRDHYSGSKRVLH

SEQ ID NO: 1393 - DNA, 654 bp, Xanthomonas axonopodis (pv. citri)
  CDS (1)..(654)
atgcctggctctgaatgggctgcccggtggcagacggttgaggacggcttgtcggccgccgggtgcgccgccatcatggcgacctttcgaaccgcccattatcccggctccatgcatatcacgccagttttcgccgccagcgcccgacgcgccgcggccagcctgttgctgggcctgctgctcctggggggctgttcgtcgcatgcgccagtgcggcgcccggccgcgccaccaccggctgcgcgcgtatggccgcaggtgccgccggccgacccggccgccgccaacaacatcctgatgcgcgcgctggggctggtgggcaccccgtaccggtttggcggcaatacgcctcagaccggcttcgactgcagcgggctggtcacctatgtctaccaagacgtattggccctggcgctaccgcgcacctcgcgcgaactggccgcgatccagggcccgcgcatcccgcccgagcgacttgccaccggcgatctggtgtttttcggcgctggaggcaacgtgacccatgttggcatttatgtcggtgaaggccgcttcgtgcatgcccctaccaccggcggtacggtccgcttggattttctggatggagcttactggcgtgaccattattcaggttcaaagcgggttttgcactaa

SEQ ID NO: 1394 - protein, 217 aa, Xanthomonas axonopodis (pv. citri)
MPGSEWAARWQTVEDGLSAAGCAAIMATFRTAHYPGSMHITPVFAASARRAAASLLLGLLLLGGCSSHAPVRRPAAPPPAARVWPQVPPADPAAANNILMRALGLVGTPYRFGGNTPQTGFDCSGLVTYVYQDVLALALPRTSRELAAIQGPRIPPERLATGDLVFFGAGGNVTHVGIYVGEGRFVHAPTTGGTVRLDFLDGAYWRDHYSGSKRVLH

SEQ ID NO: 1395 - DNA, 465 bp, Salmonella typhimurium
  CDS (1)..(465)
atgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgttacggcggcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaa

SEQ ID NO: 1396 - protein, 154 aa, Salmonella typhimurium
MRFWLLVITALFLAGCSTHRAPAPNARLSDSITVIAGLNDQLQSWRGTPYRYGGMSRRGVDCSGFVVVTMRDKFDLQLPRDTREQSKIGTRIDKDELLPGDLVFFKTGSGESGLHVGIYDTNNEFIHASTSRGVMRSSLDNVYWRKNFWQARRI

SEQ ID NO: 1397 - DNA, 480 bp, Pasteurella multocida
  CDS (1)..(480)
atgttattaaagcaatgtgtattcgtaagtctgttttgtctactatctgcctgtggtcatcatagcaatacggggaaaatcagttataaggggcaactcaatgatccgattatggtgattgccttattgagtgagcaacaacgtgagtgggcaggaacgccctatcgtttaggtggacaaagtcgtgccggtattgattgctctggttttgtacaaaaaacgtttttagatcgctttgatattcttttaccgagaatgacggtacagcaagctaattatggaaaattagtgtctaaacaagatatccaaactggtgatttagtgttttttaaaaccggtcgaggtccaaatggctatcatgttggtatttatgtcaaagatgatttgtttttgcatgcctcaaccaaaggaggggtaatctattcttctttaaatagcccctattggtcaaaaaaatattggcaagcaagacgcatttaa

SEQ ID NO: 1398 - protein, 159 aa, Pasteurella multocida
MLLKQCVFVSLFCLLSACGHHSNTGKISYKGQLNDPIMVIALLSEQQREWAGTPYRLGGQSRAGIDCSGFVQKTFLDRFDILLPRMTVQQANYGKLVSKQDIQTGDLVFFKTGRGPNGYHVGIYVKDDLFLHASTKGGVIYSSLNSPYWSKKYWQARRI

SEQ ID NO: 1399 - DNA, 480 bp, Treponema denticola ATCC 35405
  CDS (1)..(480)
atgaaaaaaatatttatttttgttcttttaagcttttttttaaacggatgtatgacttttggagctcaaccgcccgaatctccgcgtctcgattttataaatgctgcatataaatacctaaaaactccatataaatatgcaggcactactaaggccggaatggattgttcaggttttgtatatagggcagctcttgacgctctcgaaattagcatccccagaagcacaaagggtcttgcagactttgctaaacggatctcggacaaagaagttcaacccggcgatcttttatttttttatactgtgggaaacaaagtatcacacgtaggaatttacataggtaacagggaattcatccattccgcttcgcagggtaaacatacaggtgtaataatttcttctcttgatgaaaaatattggaaagacacgtaccgctttgccggccgtattttggatccggaagatatttttaacgaataa

SEQ ID NO: 1400 - protein, 159 aa, Treponema denticola ATCC 35405
MKKIFIFVLLSFFLNGCMTFGAQPPESPRLDFINAAYKYLKTPYKYAGTTKAGMDCSGFVYRAALDALEISIPRSTKGLADFAKRISDKEVQPGDLLFFYTVGNKVSHVGIYIGNREFIHSASQGKHTGVIISSLDEKYWKDTYRFAGRILDPEDIFNE

SEQ ID NO: 1401 - DNA, 25 bp, Primer
atgcgtttctgccttattttgatca

SEQ ID NO: 1402 - DNA, 23 bp, Primer
ttagattcgtctcgcctgccaga

SEQ ID NO: 1403 - DNA, 1224 bp, Escherichia coli
  CDS (285)..(1166)
gatccttatctggatgagacggtgaatatcgcactcgatctggcgaagcttgaaaaagccagacccgcggaacaacccgctcccgtcaagtaatatcaatcaggcacaagaaattgtgcctgattttttaacagcgacaagatgccgtaaatcagatgctacaaaatgtaaagttgtgtctttctggtgacttacgcactatccagacttgaaaatagtcgcgtaacccatacgatgtgggtatcgcatattgcgttttgttaaactgaggtaaaaagaaaattatgatgcgaatcgcgctcttcctgctaacgaacctggccgtaatggtcgttttcgggctggtactgagcctgacagggatacagtcgagcagcgttcaggggctgatgatcatggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaacgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtattctggcgcagcttgccgcgggttttatgggcggaaatcgtgatgaaggtgaagagagcaacggcaacccgctgatctactttgcggttgcaacggttctggaactggtgtttggtattctggcgagcattatcaccatgtggttctcgcgtcatcgtgaattccatgctgatgccggttcggcaaaactggttggtcgcgagaaaatgattgccgcgctgcagcgcctgaaaaccagctatgaaccgcaagaagcaaccagcatgatggctctctgcattaacggtaagtcgaaatcgctcagtgagttgttcatgacccacccgccgctggataaacgaattgaagctctgcgtacgggtgaatacctgaagtaatatgaagtaaatactaaaaagcgcgtcctgatcgacgctttttttatgccctggatcg

SEQ ID NO: 1404 - protein, 293 aa, Escherichia coli; identical to SEQ ID NO: 514

SEQ ID NO: 1405 - DNA, 882 bp, Yersinia pestis; identical to SEQ ID NO: 525
  CDS (1)..(882)

SEQ ID NO: 1406 - protein, 293 aa, Yersinia pestis; identical to SEQ ID NO: 526

SEQ ID NO: 1407 - DNA, 882 bp, Salmonella typhimurium
  CDS (1)..(882)
atgatgcgaatcgcgctcttcctgctgacgaacctggccgtgatggtcgttttcgggctggttctgagcctgacggggatacagtcgagcagcgtgcaaggcttgctgatcatggcgctgctgtttggttttggcggttcttttatttcattgctgatgtccaaatggatggcgttaaaatccgtaggaggggaagttattgaacagcctcgcaatgaaagagaacgctggttgatgaacaccgtagcaacgcaagcgcgccaggccggtatcgccatgccgcaggttgctatctaccatgcgccggacattaacgcgtttgcgacgggcgcccgccgtgacgcctcattggtcgctgtgagcaccggtctgttgcaaaatatgagccctgacgaggcggaagccgtcattgcgcatgaaatcagccatattgccaatggcgatatggtgacgatgacgttgattcagggggtggttaacaccttcgttatctttatttcgcgcattatcgcgcaaattgctgcaggttttctgggcggcaaccgtgatgaaggcgaaggaagtaacggtaatccgctaatctatttcgccgttgcgacggtgctggaactggtcttcggtattctggcaagcattatcaccatgtggttctcccgttaccgtgagtttcatgccgatgcgggatcggcgaagctggttggtcgtgaaaaaatgattgccgcgttgcagcgcctgaaaaccagctacgagccgcaagaagcgaccagcatgatggcgttttgtattaacggtaaatcgaaatcgttaagcgagctgtttatgacgcacccaccgctggataaacgcattgaagcgctgcgtagcggcgagtacctgaaataa

SEQ ID NO: 1408 - protein, 293 aa, Salmonella typhimurium; identical to SEQ ID NO: 524

SEQ ID NO: 1409 - DNA, 882 bp, Escherichia coli; identical to SEQ ID NO: 519
  CDS (1)..(882)

SEQ ID NO: 1410 - protein, 293 aa, Escherichia coli; identical to SEQ ID NO: 520

SEQ ID NO: 1411 - DNA, 864 bp, Vibrio cholerae; identical to SEQ ID NO: 531
  CDS (1)..(864)

SEQ ID NO: 1412 - protein, 287 aa, Vibrio cholerae; identical to SEQ ID NO: 532

SEQ ID NO: 1413 - DNA, 879 bp, Buchnera aphidicola str. APS (Acyrthosiphon pisum)
  CDS (1)..(879)
atgactcgtattgttcttttcttattaactaatttagcagttatgttaatatttagtctaattcttttcctgacaggtattcaatctaatactatttatggtttattaattatgtcaggtttatttggttttagtggttctattttatcgttaattttatcaaagtggattgcgttgcgttctgtaaatggggaaatcatcactcatccacgaaatgaagtagaaagttggcttattaatactgtacgtcaacaatcaattcaaaaaggtattattatgccccaaattgcagtatatcatgcgactgatattaatgcatttgcaacaggtgcacgtcgtaattctgctctaattgctgtttctacaggattattagaaaatatgactcatcatgaagcagaagcagtaattgctcatgaaattagtcatatcgcaaatggtgacatgattactatgaccttagtacaaggtgttgttaacacttttgtgatttttatatctcgttttctttcacaaatcataagcaatgtcatgtcaagcaatcgaaatgagaataatacagaagaaaaaaactctttcgtatattttttagtttctacatttctagaattaatttttggaattttagccagtattattactatgtggttctccagacatcgtgaattttatgctgatgctagttctgcgaaaatggtaggtcgcgaaaaaatgattgctgctttgaatcgtttaaaaacaagtcatgaaccccaagaatctgatagtatgattgcattttgtatcaacggaaaatccaaatcttttttaaaattatttgcatctcatccttctttagaaaacaggatagaggcattatataatcaagaatatatgtag

SEQ ID NO: 1414 - protein, 292 aa, Buchnera aphidicola str. APS (Acyrthosiphon pisum); identical to SEQ ID NO: 528

SEQ ID NO: 1415 - DNA, 852 bp, Haemophilus influenzae; identical to SEQ ID NO: 533
  CDS (1)..(852)

SEQ ID NO: 1416 - protein, 283 aa, Haemophilus influenzae; identical to SEQ ID NO: 534

SEQ ID NO: 1417 - DNA, 879 bp, Buchnera aphidicola str. Sg (Schizaphis graminum); identical to SEQ ID NO: 537
  CDS (1)..(879)

SEQ ID NO: 1418 - protein, 292 aa, Buchnera aphidicola str. Sg (Schizaphis graminum); identical to SEQ ID NO: 538

SEQ ID NO: 1419 - DNA, 861 bp, Pasteurella multocida; identical to SEQ ID NO: 535
  CDS (1)..(861)

SEQ ID NO: 1420 - protein, 286 aa, Pasteurella multocida; identical to SEQ ID NO: 536

SEQ ID NO: 1421 - DNA, 882 bp, Escherichia coli
  CDS (1)..(882): r means g or a
atgatgcgaatcgcgctcttcctgctaacgaacctggccgtaatggtcgttttcgggctggtactgagcctgacagggatacagtcgagcagcgttcaggggctgatgatcatggccttgctgttcggttttggtggttccttcgtttcgcttctgatgtccaaatggatggcattacgatctgttggcggggaagtgatcgagcaaccgcgtaacgaaagggaacgttggctggtcaatactgtagcaacccaggctcgtcaggcggggatcgctatgccgcaagtggctatctaccatgcgccggacatcaacgcttttgcaaccggtgcgcgccgtgatgcctctctggttgctgtcagcaccggtttgctgcagaacatgagcccggatgaagccgaggcggtaattgctcacgaaatcagccacatcgccaatggtgatatggtcaccatgacgctgattcagggcgtggtgaacaccttcgttatctttatttcccgtatcctggcgcagcttgccgcgggttttatgggcggaaatcgtgatgaaggtgaagagagcaacggcaacccgctgatctactttgcggttgcaacggttctggaactggtgtttggtattctggcgagcattatcaccatgtggttctcgcgtcatcgtgaattccatgctgatgccggttcggcaaaactggttggtcgcgagaaaatgattgccgcgctgcagcgcctgaaaaccagctatgaaccgcaagaagcaaccagcatgatggctttctgcattaacggtaagtcgaaatcgctcagtgagttgtttatgactcacccgccgctggataaacgtattgaagctctgcgtrcgggtgaatacctgaagtaa

SEQ ID NO: 1422 - protein, 293 aa, Escherichia coli
  misc_feature (288)..(288): Xaa can be Ala or Thr
MMRIALFLLTNLAVMVVFGLVLSLTGIQSSSVQGLMIMALLFGFGGSFVSLLMSKWMALRSVGGEVIEQPRNERERWLVNTVATQARQAGIAMPQVAIYHAPDINAFATGARRDASLVAVSTGLLQNMSPDEAEAVIAHEISHIANGDMVTMTLIQGVVNTFVIFISRILAQLAAGFMGGNRDEGEESNGNPLIYFAVATVLELVFGILASIITMWFSRHREFHADAGSAKLVGREKMIAALQRLKTSYEPQEATSMMAFCINGKSKSLSELFMTHPPLDKRIEALRXGEYLK

SEQ ID NO: 1423 - DNA, 870 bp, Haemophilus ducreyi; identical to SEQ ID NO: 539
  CDS (1)..(870)

SEQ ID NO: 1424 - protein, 289 aa, Haemophilus ducreyi; identical to SEQ ID NO: 540

SEQ ID NO: 1425 - DNA, 777 bp, Vibrio vulnificus
  CDS (1)..(777)
atgcagccaggaagcctctcaggtttattggtgatggctgcggtatttggttttggtggtgcatttatctccttgatgatgtcaaagggaatggcactacgctctgtcggtggaatggtgatcgagagccctcgtaacgagacagagcactggttattggaaacggtgagtcgccaagctcagcaagcgggcattggtatgccaaccgttgccatttatgattcgccggatatcaacgcgtttgcaactggggcaaagcgtgacgattcgctggtcgcggtttctacgggtctgctgcacaacatgacacgtgatgaagcagaagcggtgctggcgcatgaggtgagccatatcgccaatggtgacatggtgaccatgacgttgatgcagggtgttgtgaacaccttcgttatcttcttgtctcgctttattgccaacatggtggcttctaataacagcgatgaagaaggtgaaggttcaaacatgatggtgtatttcgcggtttctatcgcgcttgagctggtgtttggtttcctcgcgagcttcatcaccatgtggtatagccgtcatcgtgaattccatgccgatgcgggagccgcccgtctagttggtaaagagaaaatgatagcggctctagagcgtctaaaaatgagccaagaatcaaaactggatggcaccatgatggcatttggtatcaacggtaagcaatctctaacggaactgcttatgagccacccgccactcgataagcgtatcgctgcccttcgcaatttctaa

SEQ ID NO: 1426 - protein, 258 aa, Vibrio vulnificus; identical to SEQ ID NO: 530

SEQ ID NO: 1427 - DNA, 879 bp, Xanthomonas axonopodis (pv. citri); identical to SEQ ID NO: 543
  CDS (1)..(879)

SEQ ID NO: 1428 - protein, 292 aa, Xanthomonas axonopodis (pv. citri); identical to SEQ ID NO: 544

SEQ ID NO: 1429 - DNA, 879 bp, Xanthomonas campestris (pv. campestris); identical to SEQ ID NO: 541
  CDS (1)..(879)

SEQ ID NO: 1430 - protein, 292 aa, Xanthomonas campestris (pv. campestris); identical to SEQ ID NO: 542

SEQ ID NO: 1431 - DNA, 22 bp, Primer
atgatgcgaatcgcgctcttcc

SEQ ID NO: 1432 - DNA, 24 bp, Primer
ttacttcaggtattcacccgtacg

SEQ ID NO: 1433 - DNA, 1530 bp, Escherichia coli
  CDS (385)..(1431)
aaatgggcgcgaaagcggtgctgaaaagcggcggtaacccattacagaatgtgctgggaagcctgggaagcctgggggggctgcaatcctcaatccaaaccgagtggaaaaagcaggaaaaagatttccagcagtttggcaaagatgtttgtagccgcgttgtgactctggaagatagccgcaaagccctggtcgggaatttaaaataatcctctattttaagacggcataatacttttttatgccgtttaattcttcgttttgttacctgcctctaactttgtagatctccaaaatatattcacgttgtaaattgtttaacgtcaaatttcccatacagagctaagggataatgcgtagcgttcacgtaactggaggaatgaaatggagtttttcaaaaagacggcacttgccgcactggttatgggttttagtggtgcagcattggcattacccaatatcaccattttagcaaccggcgggaccattgccggtggtggtgactccgcaaccaaatctaactacacagtgggtaaagttggcgtagaaaatctggttaatgcggtgccgcaactaaaagacattgcgaacgttaaaggcgagcaggtagtgaatatcggctcccaggacatgaacgataatgtctggctgacactggcgaaaaaaattaacaccgactgcgataagaccgacggcttcgtcattacccacggtaccgacacgatggaagaaactgcttacttcctcgacctgacggtgaaatgcgacaaaccggtggtgatggtcggcgcaatgcgtccgtccacgtctatgagcgcagacggtccattcaacctgtataacgcggtagtgaccgcagctgataaagcctccgccaaccgtggcgtgctggtagtgatgaatgacaccgtgcttgatggccgtgacgtcaccaaaaccaacaccaccgacgtagcgaccttcaagtctgttaactacggtcctctgggttacattcacaacggtaagattgactaccagcgtaccccggcacgtaagcataccagcgacacgccattcgatgtctctaagctgaatgaactgccgaaagtcggcattgtttataactacgctaacgcatccgatcttccggctaaagcactggtagatgcgggctatgatggcatcgttagcgctggtgtgggtaacggcaacctgtataaatctgtgttcgacacgctggcgaccgccgcgaaaaccggtactgcagtcgtgcgttcttcccgcgtaccgacgggcgctaccactcaggatgccgaagtggatgatgcgaaatacggcttcgtcgcctctggcacgctgaacccgcaaaaagcgcgcgttctgctgcaactggctctgacgcaaaccaaagatccgcagcagatccagcagatcttcaatcagtactaatcgcctcgccccggtatcgtgccggggctttttcacttcagactcacgtccattgccaattttaattaccctaatgataatcaccggaataaattattt

SEQ ID NO: 1434 - protein, 348 aa, Escherichia coli
MEFFKKTALAALVMGFSGAALALPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 1435 - DNA, 1047 bp, Erwinia chrysanthemi
  CDS (1)..(1047)
atggaaagatggtttaaatctctgtttgttctggttttattttttgtttttacggcgagtgcggcagataaactgcccaatatcgttatcctggcgaccggcggtacaattgccggctcagcggcaacgggtacccaaaccacaggttacaaggctggcgcgcttggcgtggatacgctaatcaacgctgtgcctgaggtgaagaaactggctaatgtgaagggggagcagttctccaacatggccagcgaaaacatgaccggtgatgtggtgctcaagctgagccagcgtgtgaatgaactgctggcacgggatgatgtggatggtgtggtgatcacccacgggaccgacacggtggaagagtcggcttactttcttcatctgacggtaaaaagtgacaagccagtggtgtttgtcgcagcgatgcgtccggcaacggccatcagtgctgacggcccgatgaacctgctggaagcggtacgcgtggcgggtgacaaacagtctcgcggtcgcggcgtgatggtggtgcttaatgatcgtatcggctctgcccgctacatcaccaagaccaacgcctctacgctggatacgttcaaggcgaatgaagaaggctacctgggcgtcattattggtaaccgcatttactaccaaaaccgtatcgacaagctgcataccacccggtctgtgttcgacgtgcgtggcctgacttcgctgccgaaagtcgacattctttatggctatcaggatgacccggaatatctgtatgacgcggctatccagcatggcgtaaaaggtatcgtctatgccggtatgggcgcaggttcagtgtccgttcgcggtattgccggtatgcgcaaggcgatggagaaaggcgttgttgtgatccgttctacccgcacaggcaatggtattgtgccgccggatgaagagctgccaggtctggtttctgactctcttaacccggcacatgcccgcattctgttgatgctggcattgactcgcaccagtgatccgaaagtcattcaagagtatttccatacttattga

SEQ ID NO: 1436 - protein, 348 aa, Erwinia chrysanthemi
MERWFKSLFVLVLFFVFTASAADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVLNDRIGSARYITKTNASTLDTFKANEEGYLGVIIGNRIYYQNRIDKLHTTRSVFDVRGLTSLPKVDILYGYQDDPEYLYDAAIQHGVKGIVYAGMGAGSVSVRGIAGMRKAMEKGVVVIRSTRTGNGIVPPDEELPGLVSDSLNPAHARILLMLALTRTSDPKVIQEYFHTY

SEQ ID NO: 1437 - DNA, 1050 bp, Haemophilus influenzae
  CDS (1)..(1050): n means a or g or c or t/u
atgaaattaactaaattagccttatgtactttatttggtctaggtgtttcaatagcaaatgcagctgacttaccaaatattacaatcttggcaacgggtggtaccattgcaggaagcgggcaaagttcggtaaattctgcgtataaagctggacaattaagtattgatactttaattgaagctgtaccagaaatgaaaaatattgccaacattaaaggtgagcaaattgtaaaaataggttcacaagacatgaatgacgaagtctggctaaaactggcaaaagccatcaatgctcaatgtaaaagtactgatggatttgtcattacccatggtacagataccatggaagagacggcttatttcttagatttaaccgtaaaatgtgaaaaaccggttgttctcgttggggcaatgcgtcctgcaacagaaaaaagtgctgatggcccattaaatctttacaatgctgtcgttgtcgcagcagacaaaaaatcaagtggtcgtggtgttttagtcgcaatgaataatgaagtactaggtgctcgcgatgtaacaaaaaccagtacgaccgcagtgcaaacgttccattcaccaaattatggttctctaggctatattcataacagcaaagtggactatgaacgttccccagaaagcaaacataccatcaacactccgtttaacgtagaaaaattagatagcctacccaaagtggggattatttatgcttattcaaatgcacctgtcgaaccattaaacgcattactcaatgctggctatcaagggattgtatctgcaggagttggcaatggaaatgttaatgctgcacacttagatcgcttagaaaaagccgcaaaagatagcgtcgttgtagtccgttcttctcgtgtaccaacgggttatacaactcgtgacgctgaagttgatgatagtaaatatggctttgtagcatcaggtactttaaatccacagaaagcccgcgtgctcttgcaattagctttaactcaaactaaagatccnaaagtaattcaacaatatttcgaagacttctaa

SEQ ID NO: 1438 - protein, 349 aa, Haemophilus influenzae
MKLTKLALCTLFGLGVSIANAADLPNITILATGGTIAGSGQSSVNSAYKAGQLSIDTLIEAVPEMKNIANIKGEQIVKIGSQDMNDEVWLKLAKAINAQCKSTDGFVITHGTDTMEETAYFLDLTVKCEKPVVLVGAMRPATEKSADGPLNLYNAVVVAADKKSSGRGVLVAMNNEVLGARDVTKTSTTAVQTFHSPNYGSLGYIHNSKVDYERSPESKHTINTPFNVEKLDSLPKVGIIYAYSNAPVEPLNALLNAGYQGIVSAGVGNGNVNAAHLDRLEKAAKDSVVVVRSSRVPTGYTTRDAEVDDSKYGFVASGTLNPQKARVLLQLALTQTKDPKVIQQYFEDF

SEQ ID NO: 1439 - DNA, 1047 bp, Salmonella enterica subsp. enterica serovar Typhi
  CDS (1)..(1047)
atggagtttttcaggaaaacggcattagctgctctggtaatgggtttcagcggcgcagcgttcgctttaccgaatatcaccatcttagcgaccggcggaacgatcgctggcggcggtgattcagcaacaaaatcaaattatacggcaggtaaagtcggcgtcgaaaatctggtggatgccgttcctcaattgaaggacattgcggtagtgaaaggcgagcaggtcgttaacattggctcgcaggatatgaacgatgaagtctggctcacgctggcgaaaaaaatcaataccgagtgcgacagcaccgacggtttcgtgatcacccacggtactgatacgatggaagagaccgcttatttcctcgatctgaccgtgaaatgcaataaaccggtggtactggtcggcgcgatgcgtccttccacgtcaatgagcgcagatggcccgttcaacctctataatgcggtagtaacagcggctgataaacagtctgccaaccgcggcgtgctggtggtaatgaatgataccgtcatggacggacgcgacgtcactaagaccaatacgactgacgtggcgacgtttaaagcggttaactacggcccgctgggttatatccacaacggtaaaattgactaccagcgtacgccagagcgtaaacataccacctccaccccgttcgacgtgtcgaagctgaccgcgttgccgaaagtcggtatcgtttataactatgcgaatgcgtccgatctgccggcaaaagcgctggtagacgcgggttatgacgggatcgtgagcgcaggcgtgggtaacggcaacctgtataaaacggtctttgataccctagcgaccgccgcgcacaacggtacggtagtggtgcgttcttcacgtgtgccgactggcgcaaccacgcaggatgcggaagttgacgatgcaaaatacggctttgtcgcttccggcacgctgaacccgcaaaaagcgcgtgtcttactgcaactggcgttaacccagactaaagatccaaaacagatccagacgatgttcaatcagtattaa

SEQ ID NO: 1440 - protein, 348 aa, Salmonella enterica subsp. enterica serovar Typhi
MEFFRKTALAALVMGFSGAAFALPNITILATGGTIAGGGDSATKSNYTAGKVGVENLVDAVPQLKDIAVVKGEQVVNIGSQDMNDEVWLTLAKKINTECDSTDGFVITHGTDTMEETAYFLDLTVKCNKPVVLVGAMRPSTSMSADGPFNLYNAVVTAADKQSANRGVLVVMNDTVMDGRDVTKTNTTDVATFKAVNYGPLGYIHNGKIDYQRTPERKHTTSTPFDVSKLTALPKVGIVYNYANASDLPAKALVDAGYDGIVSAGVGNGNLYKTVFDTLATAAHNGTVVVRSSRVPTGATTQDAEVDDAKYGFVASGTLNPQKARVLLQLALTQTKDPKQIQTMFNQY

SEQ ID NO: 1441 - DNA, 1038 bp, Yersinia pestis
  CDS (1)..(1038)
atgaaatatataaagctaacggtactcgccggaatatttgtagggatcagtagcccggtttttgctctgcctaatatcactttattggcaaccgggggcaccatcgcagggggaggtgattctgctacaaaatccaattataccgccggtaaattgggggtagatgcgctggtagaggccgtcccggctataaaagacattgcgaatatccagggcgaacaagtggtgaatataggctcacaagatatgaatgacgatgtttggctcacattggcgaaaaaaatcaataaagactgcacgaaaacagacggttttgtcatcactcatggaacggatactttagaagaaacggcttatttcctcgatttaaccgtcaattgtgataaacccgtggtgatagtcggcgcaatgcgcccggcaacggcattaggggccgacggcccgttgaacctctacaacgcggtggtggtcgccagtgacgcagactcggctaaacggggtgtgctggtggcgatgaatgacatggttttcactgggcgtgatgtggtaaaaaccaacaccacatcagtgcaaacattccaatcaccgaatacagggccattggggtatatctatgatggtaaagttaattatttgcatcaaccagcagcaagacaactcgcgtttgatatcagtaagctaaatacgttaccgaaagttggcattatttataactatgcaaatgcatcggacatacccgcaaaggcattgattgccgatggttatcaggggattgtcagtgctggcgtggggaatggtaatctctatcatacggttttcgatacgctggcaaccgccgcaagtcacggagttgcagttgtgcgctcgtctcgtgtgcccagtggttcaaccacagaaggtgctgaaattgatgacgctaaatacggctttgtcgctgcgggtgcacttaatccacagaaagcacgggttttattacagttagcattaacgcaaactcaaaaaccacaagaaattcaaaaactattccacacatattga

SEQ ID NO: 1442 - protein, 345 aa, Yersinia pestis
MKYIKLTVLAGIFVGISSPVFALPNITLLATGGTIAGGGDSATKSNYTAGKLGVDALVEAVPAIKDIANIQGEQVVNIGSQDMNDDVWLTLAKKINKDCTKTDGFVITHGTDTLEETAYFLDLTVNCDKPVVIVGAMRPATALGADGPLNLYNAVVVASDADSAKRGVLVAMNDMVFTGRDVVKTNTTSVQTFQSPNTGPLGYIYDGKVNYLHQPAARQLAFDISKLNTLPKVGIIYNYANASDIPAKALIADGYQGIVSAGVGNGNLYHTVFDTLATAASHGVAVVRSSRVPSGSTTEGAEIDDAKYGFVAAGALNPQKARVLLQLALTQTQKPQEIQKLFHTY

SEQ ID NO: 1443 - DNA, 963 bp, Listeria monocytogenes
  CDS (1)..(963)
atggcaaaagtagcactaattacaacaggcggtacgattgcaagtaagaaaacagcatcaggaaaacttgcatcaggtgaattatctggagaagaattagctgcattatgccaattaccaacagaaattcaaattgatatctattctacttttcaattgccatctatgcatattacgctacctgatttaatcagtctgaagcaacttatcgaatctatcttcatggatgaaacatatgatggaatagtagtgacgcacggaacagattcattagaagaaacagcatattttcttgatctcgcagtaaccgatgcacgaccaattgtagtaactggatctcagcgagcacctgaggagccgggaacagatgcctatgttaatattcgtcatgcaatttatacagcatgtgaaataaatttacgtcaagctggaacagtcgttgttttcaatgaacgaattttcgcagcgagatatgtcaaaaaagtccatgcatctaacatacaaggttttagtgcttttgggtttggttatcttggtatcattgataatgatcaagttttcctgtatcaaaaaccactggagcatgagtgttttgatattcgccttgatttaccagaagttgttgtgattaaatgttatattggcgcagacggtttgtttattgatgcagcgattgatagtggcgtttcaggaattgttttagaaggtgttggacgcgggcaagtggcgccaaaaatgatgccagctattatcagagcattagatgcgggaattccagttgtcatcacaacaagtgcggaagaaggaaatgtatatactacatatgattatgaaggcagcacgtttgacttatataatcgtggcgttattttaggaaaagattacgatagtaaaaaagcgcggatgaaattaatggtacttttagcatcccaagaagaaattaatcaaaccaatttcagataa

SEQ ID NO: 1444 - protein, 320 aa, Listeria monocytogenes
MAKVALITTGGTIASKKTASGKLASGELSGEELAALCQLPTEIQIDIYSTFQLPSMHITLPDLISLKQLIESIFMDETYDGIVVTHGTDSLEETAYFLDLAVTDARPIVVTGSQRAPEEPGTDAYVNIRHAIYTACEINLRQAGTVVVFNERIFAARYVKKVHASNIQGFSAFGFGYLGIIDNDQVFLYQKPLEHECFDIRLDLPEVVVIKCYIGADGLFIDAAIDSGVSGIVLEGVGRGQVAPKMMPAIIRALDAGIPVVITTSAEEGNVYTTYDYEGSTFDLYNRGVILGKDYDSKKARMKLMVLLASQEEINQTNFR

SEQ ID NO: 1445 - DNA, 969 bp, Brucella melitensis
  CDS (1)..(969)
atgcataattttagggagttggaaatgtctttaatttctatcggcaccctcgggggtacgattgcgatggttgaggggggaagcggaggcggtgttgtgccgaccctgaccgcggatgcactcattgccgctgtgccgcagattagaaattatgcgcagatcaaggcccaatctctttttcagcttcccagcccctcgctaaaatttcggcacggccttgaagtgataggctgggctgaaaacgaggtgaaatcgggagcggacggcatagtgctgacgcagggaaccgatacgcttgaggaaatggcattccttctggatttattgtgggaacatccgcagcccctcgtactgaccggcgccatgcgctcgccgcgcgcgccgggtgctgacggtccggccaatctggtggcggccgtattgacagccgcgagcaggcttagccgggaacgcggtgtccttgttgcaatgaacgatacaatccacgcggcacgttggataacaaaatctcatgcgctcagtgtccagacattcgtatcgtcggacagcgggccgttgggatatgtgtatgaggagacgccggtttacatcaacaccctttcgcggttgccaaaaattgaccgtacgcagttcaacgccgatgtgaagatcggcttttacgaatcgctgctggatggtgacgcgcagatgctgcgaagcatgtttgagagcggcagatatgatggaatcgtcgtcgccggttttggagcaggacatgtgtcgggcgacgaagccgacattatcgagcgctatgcgtcccgcattccggtcgtcgtagccagccggacctatggcggaaggaccgccacgaagacttatgggttccatggctccgagattgatcttcagacgaaaggcgctatgctcgcaggctggctatcccccccgcaaggcgcggttattgctatgggcactactggcagcgggtag

SEQ ID NO: 1446 - protein, 322 aa, Brucella melitensis
MHNFRELEMSLISIGTLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVAGFGAGHVSGDEADIIERYASRIPVVVASRTYGGRTATKTYGFHGSEIDLQTKGAMLAGWLSPPQGAVIAMGTTGSG

SEQ ID NO: 1447 - DNA, 1317 bp, Pyrococcus horikoshii
  CDS (1)..(1317)
atgagagtggaggaattcttgaaagaaaagaacatcaacattggcgacttcataagggtgataaaggaagaagacggagaagaggtaatttatgaaggttatgtaatgcctccatacgagttatccccaggagataccctcgttttaaaactcgaaaatggatacaacattggaatagccctcagcaagatcaggagggtagaggtaattgagagagcgaaagttaaacctgaaatacactttgaagcatttatagagggaaaacctcaccttcccgacgtaacgataataggaacggggggaacgatagccagtagaattgattacgaaacgggagcggtttatccagcctttaccgctgaggagcttgcaaaagctgttccagaaatctttgaaatagcaaatattaagcctaagctactctttaacatcttcagcgaggatatgaagccaaaacattggattaaaatagcccatgaagtcgctaaatccttaaattctggggattcaggagtcgtagttgcccacgggactgatacaatgggatataccgcagcggctttaagcttcatgctaagggatttaggaaagcccgtcatcttagttggagctcagagaagttccgatagacccagtagtgatgctgcaatgaatttgatatgctcagtgaggatgtccacaagcgacgttgcggaagtgatggtggttatgcatggggaaaccggggatacctactgtctagctcacaggggaactaaagttagaaagatgcatacgagcagaagagatgcttttagaagtataaacgatgtcccgatagcaaaggtttggccaaatggtaagatagagttcctcagggatgattacagaagaagatcagacagtgaggtatgggtggatgataagcttgaagaaaaggtagcacttgtcaaggtatatcctgggatttcatccgagataatagagttcttcatagataaaggatacagggggatagttatcgagggaactggattgggccatacaccaaatgacatcatcccatcaattcaaagggctactgaagaaggaatcgccgtatgtatgacgagccaatgcatctacggtagggtgaacttaaatgtttacgcaacgggaagaagattgctaaaggctggagttattccctgcgaggatatgctaccagagacggcatacgtaaagctcatgtgggtcctcgggcacacgcaggatcttgaggaagttaggaggatgatgttaactaactatgctggagaaattactccctatactaggtttgacacttacctgaggtga

SEQ ID NO: 1448 - protein, 438 aa, Pyrococcus horikoshii
MRVEEFLKEKNINIGDFIRVIKEEDGEEVIYEGYVMPPYELSPGDTLVLKLENGYNIGIALSKIRRVEVIERAKVKPEIHFEAFIEGKPHLPDVTIIGTGGTIASRIDYETGAVYPAFTAEELAKAVPEIFEIANIKPKLLFNIFSEDMKPKHWIKIAHEVAKSLNSGDSGVVVAHGTDTMGYTAAALSFMLRDLGKPVILVGAQRSSDRPSSDAAMNLICSVRMSTSDVAEVMVVMHGETGDTYCLAHRGTKVRKMHTSRRDAFRSINDVPIAKVWPNGKIEFLRDDYRRRSDSEVWVDDKLEEKVALVKVYPGISSEIIEFFIDKGYRGIVIEGTGLGHTPNDIIPSIQRATEEGIAVCMTSQCIYGRVNLNVYATGRRLLKAGVIPCEDMLPETAYVKLMWVLGHTQDLEEVRRMMLTNYAGEITPYTRFDTYLR

SEQ ID NO: 1449 - DNA, 963 bp, Streptococcus pneumoniae
  CDS (1)..(963)
atgcctaagaaaatccttgttttacatacgggtggaactatttccatgcaggccgatgcttctggcgctgttgtgacgagttcagataatcccatgaaccatgtgtccaacccacttgaaggaatccaagtccacgccttggacttttttaaccttccaagtccccatatcaaacccaaacatatgctggtcctctaccagaaaattaaagaggaagcagataactacgatggagtggtgatcacacacggaaccgatactttagaggaaacagcctatttccttgataccatggaagttccccatatgcctatcgttctaacaggagccatgcgtagctccaatgagctcggtagtgatggtgtttataattacctaagtgctttacgagtggccagcgatgacagggctgctgacaaaggagttttggtcgttatgaacgatgaaatccacgctgccaagtatgtcaccaaaacacatacgactaatgtcagcaccttccagactccaacacatggcccccttggtctcatcatgaaacaggaaatcctctacttcaaaacagctgaacctcgtgttcgctttgaccttgatcacatacaaggtttagtccctatcatctcggcttatgctggtatgacagatgagctgattgatatgctggatttagaacacttggacggtttgattatccaagccttcggagctggtaatattcccaaagaaacggctcaaaaattagaaagccttctgcaaaaaggaattccagtcgctctggtatcacgatgctttaacggtattgccgagcctgtttatgcataccagggtgggggcgtacagttgcaaaaagcaggcgttttctttgttaaagaactcaacgcccaaaaagctcgcttgaaactcctcatcgccctcaatgccggactaacaggacaggctttgaaagactatatggaaggctag

SEQ ID NO: 1450 - protein, 320 aa, Streptococcus pneumoniae
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 1451 - DNA, 1308 bp, Methanobacterium thermoautotrophicum
  CDS (1)..(1308)
atgtcctaccagggaagagcaaggaaattcctggaatcagcctccatagatgtgggggacatggtgctggttgagaaaccagacgtcacctatgagggcatggtccttgaccgtgcagacgatgcagatgacagacacatagtcctgaaacttgaaaacggttacaatatcggagttgaaatcagcgatgcgcggatagagctccttgagaagggatccgagccaaggatagaactcccgccagttgaagccgctgaagatccagaattacctgatgtatcaataatatcaacaggtggtaccgttgcatccataatagattaccgcacaggggctgttcaccctgcattcacagcagatgaccttctccgtgcaaaccccgaactcctggacattgcaaatataagggggcgtgcagttttcaacatactcagcgagaacatgaaaccagaatactgggtcgaaacagccagggcagtttacggtgagataaaggatggtgcagatggggtggtggtagcccatggaacagacaccatgcactacacctcagccgccctcagtttcatgctcaggaccccggtacctgtggtattcaccggcgcccagaggagctcagacagaccctcctcagatgcaagcctcaacatacagtgctctgtcagggcagcgacctcagaaatcgcagaggtcacagtctgcatgcacgcgaccatggacgacctcagctgccacctccaccggggcgtgaaggtgaggaagatgcacacatcccggagggacaccttcagaagcatgaacgcccttccccttgcagaggtgacacccgatggcattaaaatcctcgaggaaaactacagaaaaaggggctcagatgaactggaactcagcgaccgcgtggaggagagggtcgccttcataaagagctaccctggaatatcccctgatatcataaaatggcacctcgatgagggctacaggggtatcgtcattgagggcacaggcctcggtcactgccctgacaccctgataccggtcataggggaggcccatgatatgggagtccctgtggcaatgacgtcccagtgcctgaacggaagggtgaacatgaacgtctacagtacagggcgaagactgctgcaggcaggtgtcataccctgcgatgacatgctcccggaggttgcctacgtgaagatgtgctgggtcctgggacagacagatgaccctgaaatggcccgtgagatgatgagggagaacattgcaggtgagatcaatgagaggacatcgatagcatacttcaggggatga

SEQ ID NO: 1452 - protein, 435 aa, Methanobacterium thermoautotrophicum
MSYQGRARKFLESASIDVGDMVLVEKPDVTYEGMVLDRADDADDRHIVLKLENGYNIGVEISDARIELLEKGSEPRIELPPVEAAEDPELPDVSIISTGGTVASIIDYRTGAVHPAFTADDLLRANPELLDIANIRGRAVFNILSENMKPEYWVETARAVYGEIKDGADGVVVAHGTDTMHYTSAALSFMLRTPVPVVFTGAQRSSDRPSSDASLNIQCSVRAATSEIAEVTVCMHATMDDLSCHLHRGVKVRKMHTSRRDTFRSMNALPLAEVTPDGIKILEENYRKRGSDELELSDRVEERVAFIKSYPGISPDIIKWHLDEGYRGIVIEGTGLGHCPDTLIPVIGEAHDMGVPVAMTSQCLNGRVNMNVYSTGRRLLQAGVIPCDDMLPEVAYVKMCWVLGQTDDPEMAREMMRENIAGEINERTSIAYFRG

SEQ ID NO: 1453 - DNA, 1089 bp, Pseudomonas aeruginosa
  CDS (1)..(1089)
atgaagccattgctccacgcgttcgcccccggtgttatggccctgatgctcctgctgccgcaggccgcccaggccaaggaagtcgcaccgcaacagaaactgtccaacgtggtcatcctggccaccggcggcaccatcgccggcgccggcgccagcgccgccaacagcgccacctacaccgccgccaaggtgccggtcgaccagttgctggccagcgtgccgcagctcaaggacatcgccaacgtccgcggcgaacaggtgttccagatcgcctcggaaagcttcaccaacgagaacctgctggaactgggcaagaccgtcgccaagctggccgatagcgacgacgtcgacggcatcgtgatcacccacggtaccgacaccctggaagagaccgcctacttcctgaccctggtcgagcacaccgagaagcctatcgtggtggtcggctcgatgcgcccgggcaccgcgatgtccgccgacggcatgctcaacctgtacaacgccgtggcggtggccggcgacaagtcggcacgcggcaagggcgtgctgatcaccatgaacgacgagatcctctccggccgcgacgcgagcaagatggtcaacatcaagaccgaagcgttcaagagcccgtggggcccgctgggcatggtggtcgagggcaagagctactggttccgcgcaccggtgaagcggcacacggtgaactccgagttcgacatcaagcagatctccgcgctggctccggtggaaatcgcctacagctacggcaacgtcagcgacaccgcctacaaggccctggcccaggcgggcgccaaggcgatcatccatgccggcaccggcaacggctcggtgcccgcgcgcgtggtgccgaccctgcaggaactgcgcaagcagggcgtgcagatcatccgctcctcgcacgtcaatgccggcggcttcgtcctgcgcaacgccgagcagccggacgacaagaacgactggatcgtcgcccacgacctgaacccgcagaaggcgcgcatcctggccgcggtcgcgatgaccaagacccaggacagcaaggagctgcaacggatcttctgggaatactga

SEQ ID NO: 1454 - protein, 362 aa, Pseudomonas aeruginosa
MKPLLHAFAPGVMALMLLLPQAAQAKEVAPQQKLSNVVILATGGTIAGAGASAANSATYTAAKVPVDQLLASVPQLKDIANVRGEQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 1455 - DNA, 1254 bp, Methanococcus jannaschii
  CDS (1)..(1254)
atgaatgttggagatgttataagggtagagacagacaaagggatttttgaaggtatcttattgccatcaactaacgaaaatatcattacaataaagatgaaaaacggttataacgttggaatattaaaagaaaatgtaaaaaatattgagattattgctaaaggagaaaagccaaagtatgaactacctccattaaacattgaaaaaaatgaaaaattaaaaacaatctctattttatccactggagggacagtagcttcaaaggttgattataaaacaggagctgttcatccttcttttacagcagatgatttaattagggctgtaccagagcttttagacattgccaacataaaaggaagggctgtaatgaacatattaagcgaaaatatgaaaccagagtattggagaaagattgctgaagagataaaaaaagagatagaagagggagctgatggaattgttattgcccatggaacagacactatgagctatacagcttcagctctctcatttatggttaaagctgatgtcccaataattttggttggagctcagagaagtagtgacagaccttcatcagatgctgctctaaacttaataagtgctgttttagctgcaagagaaccaattaaaggagtttatgtagtaatgcatggggagagtggagatacattttgctatctacataagggagttaaagttaggaaatgccattcatcaagaagagatgcatttaaatctataaattcaattccagtagctaagataaacccatttacaaaggaaatcatctatttgcaggaagttgaaaaatcagataacagcaaaaaggtagagataaacacaaacttagaagaaaaagtggctttaataaaagtatatcctggaatggatggggaaattattagattctatgttgataaagagtataaagggattgtcttagaagggacgggtttaggtcatgccccagagtatatatttgaacacataaagtatgcaactgataaaggagtagttgttgtaatgactactcaaacaatcaatggaagagtaaatatgaacgtctattcaaatggaagagaattacaaaaattaggagttattggttgtgaagatatgcctccagaagttgcattggttaaattaatgtatctcttaggaaattatgagccagaggaagttaaaaaattaattaataagaatttggttggggagattgaatataggagcagatttgatgcatactaa

SEQ ID NO: 1456 - protein, 417 aa, Methanococcus jannaschii
MNVGDVIRVETDKGIFEGILLPSTNENIITIKMKNGYNVGILKENVKNIEIIAKGEKPKYELPPLNIEKNEKLKTISILSTGGTVASKVDYKTGAVHPSFTADDLIRAVPELLDIANIKGRAVMNILSENMKPEYWRKIAEEIKKEIEEGADGIVIAHGTDTMSYTASALSFMVKADVPIILVGAQRSSDRPSSDAALNLISAVLAAREPIKGVYVVMHGESGDTFCYLHKGVKVRKCHSSRRDAFKSINSIPVAKINPFTKEIIYLQEVEKSDNSKKVEINTNLEEKVALIKVYPGMDGEIIRFYVDKEYKGIVLEGTGLGHAPEYIFEHIKYATDKGVVVVMTTQTINGRVNMNVYSNGRELQKLGVIGCEDMPPEVALVKLMYLLGNYEPEEVKKLINKNLVGEIEYRSRFDAY

SEQ ID NO: 1457 - DNA, 999 bp, Helicobacter pylori
  CDS (1)..(999)
atggctcaaaatttacccaccattgctttattagcgacaggggggacgattgcagggagtggcgttgatgcgagcttgggtagttataagagcggtgaattgggtgtcaaagagcttttgaaggctatccccagtctcaacaagatcgcccgcattcaaggggagcaggtttctaacatcggctcacaagacatgaatgaagaaatatggttcaagctcgcccaacgcgcccaagagttgctagacgatagccgcattcaaggcgtggttatcacgcatggcacggacactttagaagagagcgcgtattttttaaacttggttttacactccacaaaaccggtcgtgctagtgggagcgatgcgtaacgcttcttctttgagcgcggatggggctttgaatttatattatgctgtgagcgtagcggttaatgaaaaaagcgcgaataagggcgtgttggtggtcatggatgatactatttttagggttagagaggtggttaaaacgcacaccacccacatttccacctttaaagccttaaatagtggcgcgatagggagcgtgtattatggcaaaacgcgttattacatgcagcctttgagaaaacacaccacagagagcgaattttccctttcacaactcaaaacccccttacctaaagtggatattatttacacgcatgccggcatgacccctgatttattccaagcgagcctaaactcgcatgcaaaaggcgttgtgatagccggggtgggtaatgggaatgtgagcgctgggtttttaaaagcgatgcaagaagcgagccaaatgggggtggttattgttcgttctagcagggtaggcagtggtggagttacttcaggtgagattgatgacaaggcttatggcttcatcacaagcgacaatttaaacccccaaaaagctagggtgcttttacaactcgctctaactaaaacaaatgataaggcaaaaatccaagaaatgtttgaagagtattag

SEQ ID NO: 1458 - protein, 332 aa, Helicobacter pylori
MAQNLPTIALLATGGTIAGSGVDASLGSYKSGELGVKELLKAIPSLNKIARIQGEQVSNIGSQDMNEEIWFKLAQRAQELLDDSRIQGVVITHGTDTLEESAYFLNLVLHSTKPVVLVGAMRNASSLSADGALNLYYAVSVAVNEKSANKGVLVVMDDTIFRVREVVKTHTTHISTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVGSGGVTSGEIDDKAYGFITSDNLNPQKARVLLQLALTKTNDKAKIQEMFEEY

SEQ ID NO: 1459 - DNA, 996 bp, Clostridium acetobutylicum
  CDS (1)..(996)
atgaagaaagttgcagtgatatttaatggtggtactatatctatgaagtttgattcaagggtaaaggcagcagttccagctttgtctggagaagaaataatgtctatggtaacaggaatagaaaaatttgctgaaattgagtcctttaacttttcggaggaaccaggacctcatatgacacctgagaaaatgatggaattatctaatttcataaaggatattttaaaaagagatgatattgtaggagcagtagttacacatggtacagactcacttgaggagacagcatatttcctagacttaaccataaaaaatgaaaaacctgtggttgtaactggttccatgagaaatagttctgaacttggatatgatggtccagccaatctttctgctgctatatgtacagcaatatcagaagaatcaaggaataaaggagtactagtatgcttcagcgatgaacttaacagcgcttctgaagttacaaaggtacattctatgcatcttaatgctttcgagagtccggattttggaccacttggaatagttgatactaataagcccatattttacagggataaagtttataatgattacatagaaacaagcagcgtagaatctaaagtggctttaataaaaacagctgtaggaatgaattctgattttatagattttgcagttgaaaaaggctataaaggaattgtaattgaagctatgggaagaggtaatgtacctccttatatggtagaaggcattgaaagggctctcaagaaaaatgtgcctgttgttcttgtctcacgatgctataaaggaagagttcttgattcctatgggtatcatggtggaggaaaagaacttagaaatataggagtaatttttggagataatcttcctggtcaaaaggcaagaataaagcttatgcttgcacttggaaagacaaaagatcttgaaaaaataagaaatatatttgaagaggatttctacaggatatataaataa

SEQ ID NO: 1460 - protein, 331 aa, Clostridium acetobutylicum
MKKVAVIFNGGTISMKFDSRVKAAVPALSGEEIMSMVTGIEKFAEIESFNFSEEPGPHMTPEKMMELSNFIKDILKRDDIVGAVVTHGTDSLEETAYFLDLTIKNEKPVVVTGSMRNSSELGYDGPANLSAAICTAISEESRNKGVLVCFSDELNSASEVTKVHSMHLNAFESPDFGPLGIVDTNKPIFYRDKVYNDYIETSSVESKVALIKTAVGMNSDFIDFAVEKGYKGIVIEAMGRGNVPPYMVEGIERALKKNVPVVLVSRCYKGRVLDSYGYHGGGKELRNIGVIFGDNLPGQKARIKLMLALGKTKDLEKIRNIFEEDFYRIYK

SEQ ID NO: 1461 - DNA, 1128 bp, Bacillus subtilis
  CDS (1)..(1128)
atgaaaaaacaacgaatgctcgtactttttaccgcactattgtttgtttttaccggatgttcacattctcctgaaacaaaagaatccccgaaagaaaaagctcagacacaaaaagtctcttcggcttctgcctctgaaaaaaaggatctgccaaacattagaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcagcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaactacaacagatacatttaaatcagaagaaatgggcttcgtcggaacaattgcagatgatatctattttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgatgcagccgaaaaaggggcggacagcgcagtcaaaaaaggcgttacagtggtgcgctctacccgcacgggaaatggtgtcgtcacaccaaaccaagactatgcggaaaaggacttgctggcatcgaactctttaaacccccaaaaagcacggatgttgctgatgcttgcgcttaccaaaacaaatgatcctcaaaaaatccaagcttatttcaatgagtattga

SEQ ID NO: 1462 - protein, 375 aa, Bacillus subtilis
MKKQRMLVLFTALLFVFTGCSHSPETKESPKEKAQTQKVSSASASEKKDLPNIRILATGGTIAGADQSKTSTTEYKAGVVGVESLIEAVPEMKDIANVSGEQIVNVGSTNIDNKILLKLAKRINHLLASDDVDGIVVTHGTDTLEETAYFLNLTVKSDKPVVIVGSMRPSTAISADGPSNLYNAVKVAGAPEAKGKGTLVVLNDRIASARYVTKTNTTTTDTFKSEEMGFVGTIADDIYFNNEITRKHTKDTDFSVSNLDELPQVDIIYGYQNDGSYLFDAAVKAGAKGIVFAGSGNGSLSDAAEKGADSAVKKGVTVVRSTRTGNGVVTPNQDYAEKDLLASNSLNPQKARMLLMLALTKTNDPQKIQAYFNEY

SEQ ID NO: 1463 - DNA, 1284 bp, Halobacterium sp. NRC-1
  CDS (1)..(1284)
atgacagcagacccaggggatcgcgtgcgcgtcacgcacggtgacgccagccacgagggcgtgttggtgccgtcaccgtcggacgaccatctcgtcgtgaaactcgactcggggtacaacgtgggcgtcgacaccgccgacgcggacatcgatgtcctggacgccgacgccgtcaccgtcgacggcgacaccggcgaggacgcggcgggatcgaccgtcgagttcgacgacgacctgccgacgattgcgctcatctcgacgggcggcacgatcgcgtcgacggtcgactaccggaccggcgcggtcaccgcacagttcgacgccgaggacgtgttgcgggcggtgccggacctcgcgggccgcgccaactaccggggccgcgtcgtcgcgaacatcctctcggagaacatggagccctcgatctggcaggacctcgcggcggccgtccgcgaggagatcgaagcgggcgcggacggcgtggtcgtgatgcatggcaccgacaccatgcagttctccgcgagcgcgctctcgttcatgcttgagacgccggtcccggtggtgttcacgggcagccagcggtccgccgaccggccgtcctcggacaacgtgatgaacgccgtctgcgccgtcgaagccgcgaaaagcgacgtcgccgaggtcatggtctgcatgcacgccaccgagagcgacgaccggtgtgcgctccaccgcggcacccgcgtgcgcaagacccacaccagccgccgggacgccttcgagacggtgggtgcgaccccgctggggtacgtcgactacgacgccgccagcgaggccgcgaccgcggacgcccgcggggtcaccgtcgagggcgcacacgccgcccgcggcgacgccaccctggacgtcgcgtcggcgctggagccggcggtggagctggtgaagttcacgcccgggatgaacgagtcgctgctggcggcctgcgagggcagcgccggcgtggtcatcgagggcaccggcctgggccacgtccacagcgacctcacggacaccatcgggtcgctggtggatgacggcacgacggtcgtcatgaccagccagtgtctcgaagggcgggtgtgtgaccgcgtctacgacacgggccgggatctgctcgcggcgggcgtcgtggaggccggcgacaccctgccggggacggcgaaagtgaagctgatgtgggcactggcgaacgccgacgaccccgaggcggcgatgcaggagtcggtcgctggcgcgctcaccacgcagtcccgcccatggacggcatga

SEQ ID NO: 1464 - protein, 427 aa, Halobacterium sp. NRC-1
MTADPGDRVRVTHGDASHEGVLVPSPSDDHLVVKLDSGYNVGVDTADADIDVLDADAVTVDGDTGEDAAGSTVEFDDDLPTIALISTGGTIASTVDYRTGAVTAQFDAEDVLRAVPDLAGRANYRGRVVANILSENMEPSIWQDLAAAVREEIEAGADGVVVMHGTDTMQFSASALSFMLETPVPVVFTGSQRSADRPSSDNVMNAVCAVEAAKSDVAEVMVCMHATESDDRCALHRGTRVRKTHTSRRDAFETVGATPLGYVDYDAASEAATADARGVTVEGAHAARGDATLDVASALEPAVELVKFTPGMNESLLAACEGSAGVVIEGTGLGHVHSDLTDTIGSLVDDGTTVVMTSQCLEGRVCDRVYDTGRDLLAAGVVEAGDTLPGTAKVKLMWALANADDPEAAMQESVAGALTTQSRPWTA

SEQ ID NO: 1465 - DNA, 996 bp, Campylobacter jejuni
  CDS (1)..(996)
atgaaaaaagctaaatcaaggattgctattttaggaacaggcggaacgatagcaggcttcattgatagcactattgctacaacaggatatgcggccggagccattgatatagatgtattaattaaagcagttccgcaaattagagatttagcagatattagttgggagcaaatagcaaatattgatagttcaaatatgtgtgatgaaatttggttaaggcttgctaaaaaaattgctaagctttttgctgaggggatagacggtgtggtgataactcatggtactgatactatggaagaaactgcttattttttaaatttaaccattaaaagtgataagcccgtagttctagttggcgctatgcgtccatcaactgctataagtgcggatggtccgaaaaatctttataatgcagtggcattagttgtcaataaagaagctaagaataagggtgttatggtagctataaatgataaaattttaagcgctagaggcgtagtaaaaactcatagtttaaatgttgatgctttctcttctcctgattttggggatttgggttatatagtagatggtaaagtctttttctataataatgttattaaagctcacacaaaaaacgctccttttgatgtaagcaaactcacaagtttgccaaaagtagatattctttatagctattcaaatgatggtagtggtgtcgctgcaaaagctttatttgaacatggaactaagggcatagttgttgcaggaagtggagcaggaagtatacacaaaaatcaaaaagatgttttaaaagagcttttaaaaaaagggcttaaggttgttgtaagttcaagggttgtagcaggttgtgttgctgtgagtgattcagatgaaaaattaggttttattagtgctgaagatttaaatcctcaaaaagcaagagttttgcttatgttagcacttacaaaaacaagtgatcctaaaaaaattcaagagtattttttaaaatattaa

SEQ ID NO: 1466 - protein, 331 aa, Campylobacter jejuni
MKKAKSRIAILGTGGTIAGFIDSTIATTGYAAGAIDIDVLIKAVPQIRDLADISWEQIANIDSSNMCDEIWLRLAKKIAKLFAEGIDGVVITHGTDTMEETAYFLNLTIKSDKPVVLVGAMRPSTAISADGPKNLYNAVALVVNKEAKNKGVMVAINDKILSARGVVKTHSLNVDAFSSPDFGDLGYIVDGKVFFYNNVIKAHTKNAPFDVSKLTSLPKVDILYSYSNDGSGVAAKALFEHGTKGIVVAGSGAGSIHKNQKDVLKELLKKGLKVVVSSRVVAGCVAVSDSDEKLGFISAEDLNPQKARVLLMLALTKTSDPKKIQEYFLKY

SEQ ID NO: 1467 - DNA, 969 bp, Bacillus halodurans
  CDS (1)..(969)
atgaaaaaagttttagttatacacacaggtggaacgattgcgatgcatgaagatgaaaaagggggcgtacagcctaaagagacaaatcccctgtttgccaccgtcgaatcgttaacatcgattgcctcgatcgaagtcgatgattttctcaatattccttccccccatatgacacctgagctcatgtttcagttggctgagcgactaaagagccgagtaggtaatgaatcgtttgatggggtcgtgattacacatgggacggatacgttagaagaaacagcctaccttctagatttgttactcgattgggaagtccctgtcgttgtcacaggggcgatgcgttccagtaatgagctcggagcggacggaccacacaattttatttctgctgtcaaaacggctgctacagatgaagcaaaaggaaaaggagttctcgtcgtatttaacgacgaaattcatacagcaaaaaacgtcacgaaaactcatacgagtaacgtcgccacgttccaaagtccacagtatgggccgattgggattgtcacgaaacgaggcgttaccttccaccacgccccttcatacaaagagagctatacggtctcaagcatcgatcatcgagttgtgctattaaaggcctacgcaggcatggatgggtccgttgttgatgcgattgccgacacgggaattgacggcctagtcattgaggctttcggacaaggaaacttaccaccagctgtcgtcccaagcatcaaacgtcttcatcaagccaacattccagtggtactcgtgtcaagaagcgttagtggtatcgttcaggaaacgtacgcttacgaggggggcgggcgtcacctaaaagatttaggggttatttttacgaacggtttaaatggacaaaaagcacgattaaagctactcgtcgcccttgaattgacgaccgatcgtaagaaattacaagaaatctttttcaaataa

SEQ ID NO: 1468 - protein, 322 aa, Bacillus halodurans
MKKVLVIHTGGTIAMHEDEKGGVQPKETNPLFATVESLTSIASIEVDDFLNIPSPHMTPELMFQLAERLKSRVGNESFDGVVITHGTDTLEETAYLLDLLLDWEVPVVVTGAMRSSNELGADGPHNFISAVKTAATDEAKGKGVLVVFNDEIHTAKNVTKTHTSNVATFQSPQYGPIGIVTKRGVTFHHAPSYKESYTVSSIDHRVVLLKAYAGMDGSVVDAIADTGIDGLVIEAFGQGNLPPAVVPSIKRLHQANIPVVLVSRSVSGIVQETYAYEGGGRHLKDLGVIFTNGLNGQKARLKLLVALELTTDRKKLQEIFFK

SEQ ID NO: 1469 - DNA, 972 bp, Lactococcus lactis subsp. lactis
  CDS (1)..(972)
atgatgaaaaaaatcttaattctccatactggtggaacaatttcgatggcggaagatgaaaatggtcatgtttccccaaatgcagtcaatccaatgaatgctgtgagcatgcagtttgatgaagtaaacttagtgacagaggatatttttaacttacctagtccacatgtcactttatcagatatgttggtcttgaaaaatcgaatcaaaacagcttttattgctgaggattttgatggagtggtcattacacatggaactgacacacttgaagaaacagcttttttccttgacactactctttcgcgtggtaaaccaattgttttaactggtgccatgcgctcaagtaatgaattaggaactgacggaatttataatttactgacagctattcgcgtcgctgctgacagtaattcaagtgaccgtggcgtacttgttgttatgaatgacgagattcattctgctcgttatgtcactaaaacacacacgactaatgtttcaacttttcaaacacctacacatggtcctgtcggtttactgacaaaaaataaaattatttatttccataaagatagtgaaaatcaacatttagatgttgcaactgttcatggaaaagtgccaattgtcaaagcatttgctgggatgactggggaaattttagatttactcaatttggaacaactagacggtcttgtcattgaagcattaggtgcgggaaatctcccacctattgctagtcaatcgcttcaaagattactagatgctaaggttcctgtcgttcttgtttctcgttgttttaacggaattgctgaacctgtctattcctatcaaggcggtggttcacaactttatgaagcaggcgtgatgtttgctgatgaagtcaattctcaaaaagcgcgtattaaattgattattgcattgaatgctggcttgaaagatttatcagaattacgacctttcttggagaattaa

SEQ ID NO: 1470 - protein, 323 aa, Lactococcus lactis subsp. lactis
MMKKILILHTGGTISMAEDENGHVSPNAVNPMNAVSMQFDEVNLVTEDIFNLPSPHVTLSDMLVLKNRIKTAFIAEDFDGVVITHGTDTLEETAFFLDTTLSRGKPIVLTGAMRSSNELGTDGIYNLLTAIRVAADSNSSDRGVLVVMNDEIHSARYVTKTHTTNVSTFQTPTHGPVGLLTKNKIIYFHKDSENQHLDVATVHGKVPIVKAFAGMTGEILDLLNLEQLDGLVIEALGAGNLPPIASQSLQRLLDAKVPVVLVSRCFNGIAEPVYSYQGGGSQLYEAGVMFADEVNSQKARIKLIIALNAGLKDLSELRPFLEN

SEQ ID NO: 1471 - DNA, 933 bp, Mycobacterium leprae
  CDS (1)..(933)
atgagccgcctcaccgtcatcgccactggaggtaccatatcgaccagtaccgaccacgatggggtgcgccgccccgcctacagcggaacggaactgaccgcacacgtggccgtcgatgtcgacgtggtggacctgatgactgtcgacagctcacagctgataccgaccgattgggatcggattcgcgctgcagtgcacacagcgaccagaaacggcgccaggggtgtggtcgtcacccacgggaccgacaccatggaagagaccgcactgtggctggacctcacctacgcggggaacgtcccagtagtcttgaccggcgccatgcgcagcgccgacgctcccaatgcagacggtccgaccaatctgcgcgaagcacttgcggtggcggctagtccggccgctcgcggcgtgggcgtactggtgtctttcgccggccgggtattacaaccgttaggcctacgcaaggcagctacgcaggatctgagcggcttcgccggcgagttgctcggcaccagctccagcggttttgcgctgacagcagccaagacccgcccgtatctcggggacctgtgcgccgccgatgcaccgcgagtcgatattgtcgcggcatacttgggcagtgattcggtggcgttggacgcttatgtgtccaccggagcgcgtggcatcgtcctggaggcactgggctcgggcaatgccggggccgcggtagtcgacggggtacgccgccattgccacaatgggatcgtgatcgcggtgtccacccgcgtgcccgaaggccatgtcagcgcaggctacggtcctggccacgacctggtagaagccggcgcggtgctggtgccatggctacgaccctcgcaggtccgggtgctgttgatggctgcgctggccgcaaacctaccgatcgctgacgtcatcgaacgctggggctaa

SEQ ID NO: 1472 - protein, 310 aa, Mycobacterium leprae [sequence omitted]

SEQ ID NO: 1473 - DNA, 1146 bp, Saccharomyces cerevisiae
  CDS (1)..(1146)
atgaaaagcgattcagttgaaatcactaccatctgcccagatgttgaaaattctcagtttgttgtgcaaagcaactgtccagagactattccagagattctaaagtctcaaaatgccgctgtgaatggcagcggcatcgcttgccaacaacgtagcttaccaagaatcaaaatcttgggtaccggtggtactattgcatcgaaagctatagactcctctcaaactgccggctatcatgttgacctgaccatccaagatctattggatgccattccagatatatccaaggtctgtgacattgaatatgagcaactatgcaacgtggattctaaagacataaacgaggatattctttataaaatttataagggcgtctcagaatcgttgcaggcttttgacggtatagttattacccatgggactgatacgctatctgaaactgcattctttattgaaagtactattgatgctggcgacgttcctattgtttttgttggttcgatgcgtccttcaaccagcgtttctgctgatggccctatgaacctttaccaagcaatttgcattgcttcaaatccaaaatctagaggaagaggtgttcttgtttccttgaatgaccaaatttcctctggttactacattactaagacgaatgcaaatagtttggattcttttaatgttagacaaggctatttaggaaattttgtcaacaatgaaattcactactattatcctcctgtgaaaccgcaaggttgccacaaattcaaactgagagtggacggtaagcattttaaattaccagaggtttgcattttatatgctcaccaagcctttccgccagctatagtcaacttagtggcagataagtatgatggtattgttcttgctaccatgggtgctggttcattgccggaggaggtcaatgaaacctgcatgaaattgagtttgccgatcgtatattccaagagatcgatggatggtatggtgcctattgccaacgtaccaaagaaaggttcaaaggaggataatctcatcgcatctggttatctaagccctgaaaagagcagaatcttgttacaattatgtttggcaggtaactacacgttggaagaaattaaacatgttttcactggcgtctatggtgggtga

SEQ ID NO: 1474 - protein, 381 aa, Saccharomyces cerevisiae
MKSDSVEITTICPDVENSQFVVQSNCPETIPEILKSQNAAVNGSGIACQQRSLPRIKILGTGGTIASKAIDSSQTAGYHVDLTIQDLLDAIPDISKVCDIEYEQLCNVDSKDINEDILYKIYKGVSESLQAFDGIVITHGTDTLSETAFFIESTIDAGDVPIVFVGSMRPSTSVSADGPMNLYQAICIASNPKSRGRGVLVSLNDQISSGYYITKTNANSLDSFNVRQGYLGNFVNNEIHYYYPPVKPQGCHKFKLRVDGKHFKLPEVCILYAHQAFPPAIVNLVADKYDGIVLATMGAGSLPEEVNETCMKLSLPIVYSKRSMDGMVPIANVPKKGSKEDNLIASGYLSPEKSRILLQLCLAGNYTLEEIKHVFTGVYGG

SEQ ID NO: 1475 - DNA, 1089 bp, Saccharomyces cerevisiae
  CDS (1)..(1089)
atgagatctttaaatacccttttactttctctctttgtcgcaatgtccagtggtgctccactactaaaaattcgtgaagagaagaattcttctttgccatcaatcaaaatttttggtaccggcggtactatcgcttccaagggttcgacaagtgcaacaacggcgggttatagcgtgggattaaccgtaaatgatttaatagaagccgtcccatctttagctgagaaggcaaatctggactatcttcaagtgtctaacgttggttcaaattctttaaactatacgcatctgatcccattgtatcacggtatctccgaggcactagcctctgatgactacgctggtgcggttgtcactcatgggaccgacactatggaggagacagctttcttcttagatttgaccataaattcagagaagccagtatgtatcgcaggcgctatgcgtccagccactgccacgtctgctgatggcccaatgaatttatatcaagcagtgtctattgctgcttctgagaaatcactgggtcgtggcacgatgatcactctaaacgatcgtattgcctctgggttttggacaacgaaaatgaatgccaactctttagatacattcagagcggatgaacagggatatttaggttacttttcaaatgatgacgtggagttttactacccaccagtcaagccaaatggatggcaattttttgacatttccaacctcacagacccttcggaaattccagaagtcattattctgtactcctatcaaggcttgaatcctgagctaatagtaaaggccgtcaaggacctgggcgcaaaaggtatcgtgttggcgggttctggagctggttcctggactgctacgggtagtattgtaaacgaacaactttatgaagagtatggtataccaattgttcacagcagaagaacagcagatggtacagttcctccagatgatgccccagagtacgccattggatctggctacctaaaccctcaaaaatcgcgtattttgctacaattatgtttgtactccggctacggcatggatcagattaggtctgttttttctggcgtctacggtggttaa

SEQ ID NO: 1476 - protein, 362 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 1477 - DNA, 1083 bp, Schizosaccharomyces pombe
  CDS (1)..(1083)
atgtggagatcaataatcagttttctattcttttctgtggcattatgtcagccatttttgtttcagaagcgctcttctaatatttcggacttcatttcatttaacgcctcacttcccaatgttacgatttttgcaatgggaggaactatcgctggatatgcttcatccagcactgaaacagttgactatgccgctggctctgtaggaatagcaacactggttgatgcagttcctgctatcaagaacttttcaaacattcgtggagtccaagttactaatgttggcagtgaagaactgacacctgctaacgttttgaatcttactcagttgattctagccgaagttgccaaacccgatgttcatggtattgttgttacacatggtacagattcacttgaagaaaccgcgatgtttttggacatgactgtcaatactacaaagcccattgtagttgttggagcaatgagaccttctactgcaattagcgctgatggccctatgaacttgttaaatgctgtagtggtagcggcctctaatcgatctattggtcgcggtactatgatcttattaaatgatcgtattggatctgccttttatactacaaagacaaatggaaatatgcttgataccttcaagtcatatgaggcaggattccttggtatgattcttgatcaaagaccacatttcttctatagccctgctacaccaactggtaaagttcattttgacgttagcaacactactgaattaccagcagttgaaattttgtatggatatcagggactgaatcctaacttggcaaaggctgcagtagatctgggagccaaaggtttagtcttagctggcatgggtgcagcttcctggacggatcctggtaatgaagtgattgatggattgattagtaaccaaagtattccggttgtgtacagccacagaacaatggatggattttctgactattattacaacggaattccttcttatttccaaaatccgcaaaaagctagatatatgcttatgctttccatcaacgctggctattccattcaaaacattactgatatattcagccttgagtattag

SEQ ID NO: 1478 - protein, 360 aa, Schizosaccharomyces pombe
MWRSIISFLFFSVALCQPFLFQKRSSNISDFISFNASLPNVTIFAMGGTIAGYASSSTETVDYAAGSVGIATLVDAVPAIKNFSNIRGVQVTNVGSEELTPANVLNLTQLILAEVAKPDVHGIVVTHGTDSLEETAMFLDMTVNTTKPIVVVGAMRPSTAISADGPMNLLNAVVVAASNRSIGRGTMILLNDRIGSAFYTTKTNGNMLDTFKSYEAGFLGMILDQRPHFFYSPATPTGKVHFDVSNTTELPAVEILYGYQGLNPNLAKAAVDLGAKGLVLAGMGAASWTDPGNEVIDGLISNQSIPVVYSHRTMDGFSDYYYNGIPSYFQNPQKARYMLMLSINAGYSIQNITDIFSLEY

SEQ ID NO: 1479 - DNA, 1071 bp, Schizosaccharomyces pombe
  CDS (1)..(1071)
atgtggggattcatagtaacttgtgggatttttctagtgttactatgccaattgcgtttactgagtaaacgcaaatcaaaatccactccttataatgccttgcttcccaatgttacagtttttgcaatgggtggtacaatcgctggatgcgcaaattcaagtcttgagattgtcaattacattcccggttcggtaggaattgaaaaattgattgaggcggttccagcgatcaaggcaattgcaaacattaatggagtacaggtaactaatatgggaagcgaaaatttaacacctgctgatgtcctaaaactagctaaattgattttagccgaagttgcaaaaccgaatgttcatggtatcgtcattacacacggtaccgactccctggaagaaacagcaatgtttcttgatctgaccatcagtactgcaaaaccaattgttgtagttggagcaatgagaccatctacggctataggcgcagacggccctatgaatttgttaaacgctgttgctgtggcatcttccaatcaatctatgggaaggggcactttagttttattaaatgaccggattggatctgcattttacactacgaaaacgaatggaaatacgcttgacacatttaaatcttatgaagctggatctcttgggatagttcttaatcaaaaaccattttacttttttagtccagctgttccaaccggtaaagtgttctttgacatttataacattaaacaactaccacgagtagacatcttatatggatatcaaggattgaatcccaaacttgctgaatcagcagtccatctgggggccaaaggcttggttttggctgctatgggagcaacttcatggactgatgatggtaatgaagttatcagctcgttaatacgggaacacaatattccagtagtgtacagtcatcgaactgcggaaggatattcaagcaactcttgtcttggcatcccctcttacttcctaaatccacaaaaagctcggtacatgcttatgcttgctattagttcaggctattctattcgagatattgaagatctgttcagcattaaataa

SEQ ID NO: 1480 - protein, 356 aa, Schizosaccharomyces pombe
MWGFIVTCGIFLVLLCQLRLLSKRKSKSTPYNALLPNVTVFAMGGTIAGCANSSLEIVNYIPGSVGIEKLIEAVPAIKAIANINGVQVTNMGSENLTPADVLKLAKLILAEVAKPNVHGIVITHGTDSLEETAMFLDLTISTAKPIVVVGAMRPSTAIGADGPMNLLNAVAVASSNQSMGRGTLVLLNDRIGSAFYTTKTNGNTLDTFKSYEAGSLGIVLNQKPFYFFSPAVPTGKVFFDIYNIKQLPRVDILYGYQGLNPKLAESAVHLGAKGLVLAAMGATSWTDDGNEVISSLIREHNIPVVYSHRTAEGYSSNSCLGIPSYFLNPQKARYMLMLAISSGYSIRDIEDLFSIK

SEQ ID NO: 1481 - DNA, 1044 bp, Photorhabdus luminescens (subsp. laumondii)
  CDS (1)..(1044)
atgaaaaagatgaaacacacagctttagccagtttattggcattaattagtggttctgcttttgctttaccaaatattacacttttggcgacgggagggacgatcgcgggtggcgggaagtctgcaatccaatccaactatgttgctggaagggttgccattgatgaattagtcaatgctgttcctgagatcaaaaatatcgccaacctaaaaggtgaacaggtggtgagtattggctcgcaagatatgaatgatcaggtgtggttaacgctagcgaaaagaatcaacgctgattgtgacaagaccgatggttttgttatcacccatggtactgacacgatggaagaaaccgcttacttcctcgatctgactacccactgccagaaacccattgtcatggttggagcgatgcgtccatctacagcgcttggtgctgatggcccgttaaatctgtataacgctgtggtcgttgccggtgatacagcatcagccaaacgcggtgtgttgatggcaatgaatgatgcggttatcagtgggcgcaccgtggtgaaaatgagcaccaccgaagttcaggcgttccagccagttaatgcgggtgctgagggctttgttcataatggcaaagtcaattattatgctgacgcgaagccgagagccaataaggctatttttgatgtcagtaaactcgataagctaccgaaagtaggtattgtttataactatgccaatgcgtctgatctgccggcgaaagctctgttgaaagatggttaccaaggcattgtcagcgctggtgtgggcaacggtaatatgtacaaggcgattttcgatactctggccttggcggctaaagatggggttgtggtcgtcagatcaagccgtgtaccggtgggatatgttactcaggatgcggaagtagacgatagcaaacatggctttgtcgcttctgaacgtttgaatccgcaaaaggccagagtacttttacaattagctctgactgaaacacgtaatccggtgaaaattcacgagatgtttgtgaaatattga

SEQ ID NO: 1482 - protein, 347 aa, Photorhabdus luminescens (subsp. laumondii)
MKKMKHTALASLLALISGSAFALPNITLLATGGTIAGGGKSAIQSNYVAGRVAIDELVNAVPEIKNIANLKGEQVVSIGSQDMNDQVWLTLAKRINADCDKTDGFVITHGTDTMEETAYFLDLTTHCQKPIVMVGAMRPSTALGADGPLNLYNAVVVAGDTASAKRGVLMAMNDAVISGRTVVKMSTTEVQAFQPVNAGAEGFVHNGKVNYYADAKPRANKAIFDVSKLDKLPKVGIVYNYANASDLPAKALLKDGYQGIVSAGVGNGNMYKAIFDTLALAAKDGVVVVRSSRVPVGYVTQDAEVDDSKHGFVASERLNPQKARVLLQLALTETRNPVKIHEMFVKY

SEQ ID NO: 1483 - DNA, 1137 bp, Helicobacter hepaticus
  CDS (1)..(1137)
atgagtatatggcgtattgctcaaatctttgtttgtgttcttgtgatggcattaggaatgctaggttgttcaagtgaagagaaagcacagcaagtgaaagaaaaaaggagtgaaaagttggaaggctttgagcaaaatgccaaaataaagaagcctaatattgtgattcttgccacaggaggcacgatagctggggcggtagattctcaaattaaaacaacaggctataatgcaggagtaataagcgttgatacattgattgaggctgtgccacagcttcaagagattgcacatattcaaggggagcaaattgccaatattgatagtgcggatatgaatgatgaaatatggctcactttggctcaacgcgtgaataagttgcttgagaatccaaagattgatggtattgttattactcacggcacagatacaatggaagagagcgcgttttttttacatcttactactcgaagtgataagcctgtagtgcttacaggagcaatgcgtcctagcactgcgataagtgctgatggtcctaagaatctttacaatgcacttgcattagcagctaatacgcaatcaaagggtaagggcgttatggtagtgatgaatgatagaatccaaagtgcgcgatatgtgagcaaaacacatagtcttaatgtagatgctttttcctcccctaatagtggcgatatgggctatattttagatggtaaagtatttttctacacatttccaaataagcctcatacaactcatagtgaatttgatgtgcgctctttgagatctctgccaaaagtggatattctttattcttatgctaatgatggcttagccatagcggctcaagctttggcaaatcaaggcacaaaaggcttagtcatagcaggaagtggcgctggaagtatccataagaatcacaaagatatgcttaaaaaattaatgcaagagggtttaatagtcgtgcaaagctcaaggataaataatggcatagtattagcaagtgaagcagatgctaaacttggctttattggcagtggggatttgaacccacaaaaagcacgtgtgcttttaatgcttgcccttactcaaaccaaaaattcagcagaaattgcaaaaatttttcaaagatattaa

SEQ ID NO: 1484 - protein, 378 aa, Helicobacter hepaticus
MSIWRIAQIFVCVLVMALGMLGCSSEEKAQQVKEKRSEKLEGFEQNAKIKKPNIVILATGGTIAGAVDSQIKTTGYNAGVISVDTLIEAVPQLQEIAHIQGEQIANIDSADMNDEIWLTLAQRVNKLLENPKIDGIVITHGTDTMEESAFFLHLTTRSDKPVVLTGAMRPSTAISADGPKNLYNALALAANTQSKGKGVMVVMNDRIQSARYVSKTHSLNVDAFSSPNSGDMGYILDGKVFFYTFPNKPHTTHSEFDVRSLRSLPKVDILYSYANDGLAIAAQALANQGTKGLVIAGSGAGSIHKNHKDMLKKLMQEGLIVVQSSRINNGIVLASEADAKLGFIGSGDLNPQKARVLLMLALTQTKNSAEIAKIFQRY

SEQ ID NO: 1485 - DNA, 1050 bp, Haemophilus ducreyi
  CDS (1)..(1050)
atgaaattgactaaattagcgctttccactttatttgcattaggattatctaccgcttacgccaacaagctcccgaatatcacgatcctagccaccggtggcacgatcgctggtagcggtgaaagtgccgtcagctctgcttatcaagctggacaactgaatattgacacgctgattgaagcggttccagaaatgaaaaaattagcaaatatcaaaggcgaacaagtggttaaaattggctcacaagatatgaatgatcaagtttggttaacattagccaacacgatcaaccaacaatgtgcttctactgatggctttgtgatcacacacggcacagatacgatggaagaaaccgcttatttcctagatatgaccgctaaatgcgaaaaaccgattgtcttagttggcgctatgcgccctgcaaccgaaaaaagtgctgatggcccacttaatttatataatgccatcgtagtggcacgagaagctaaatccgccaaacgtggcgtgttagttgcaatgaatgatcaagtacttggcgcacgagacgtcactaaaacaagcacaacggctgtccaaacctttcattcaccaaattttggcgctttaggttatattcataatagtaaagtcgattatgaacgtaatcctgaaagcaagcatacaaccaacacaccatttgatgtaaccaaattaactgatttgcctaaagtcggcattatttacgcctatgcaaatatgccaacggagccattaaaagcattattagatgctgattatcaaggtattgtggttgcgggagttggcaatggtaatatgaatgccgaaaacttagcactactcgaaacagcagctaaaaaaggcgttgccgttattcgctcatcgcgtgttccaaccggttataccacacgcgatgctgaaattgatgattcaaaatatggctttgctgcatctggtacacttaatccacaaaaagcccgcgtattgttacaattagcattaacgaaaacaaaagatatccatactatccaacaatattttgaagaattttaa

SEQ ID NO: 1486 - protein, 349 aa, Haemophilus ducreyi
MKLTKLALSTLFALGLSTAYANKLPNITILATGGTIAGSGESAVSSAYQAGQLNIDTLIEAVPEMKKLANIKGEQVVKIGSQDMNDQVWLTLANTINQQCASTDGFVITHGTDTMEETAYFLDMTAKCEKPIVLVGAMRPATEKSADGPLNLYNAIVVAREAKSAKRGVLVAMNDQVLGARDVTKTSTTAVQTFHSPNFGALGYIHNSKVDYERNPESKHTTNTPFDVTKLTDLPKVGIIYAYANMPTEPLKALLDADYQGIVVAGVGNGNMNAENLALLETAAKKGVAVIRSSRVPTGYTTRDAEIDDSKYGFAASGTLNPQKARVLLQLALTKTKDIHTIQQYFEEF

SEQ ID NO: 1487 - DNA, 1002 bp, Bordetella parapertussis
  CDS (1)..(1002)
atgcctgaggcccggctgccgcggattgctgtcctggcgaccggcggcaccattgccggcgcgcaaaccgacgcggccagcggcgcttaccgcgccggctcgtacggcgtcgggcagttgctggcggccgtgcctcaactggccggcctggcgcgcatcggcgccgagcagatcgccaacgtcggcagccagaacatgagccatgccgtctggcggcagctcgcgctgcgcgccgccgcgctgtgcgacgatccggcgaccgacggcatcgtcattacccatggcaccgatacgctggaagagaccgcttatttcctcagcctggtattgcctgtggataaaccggtggtgctgctgggcgccatgcgcccggccaccgcgttgagcgccgacgggccggtcaatctatacaacgcggtggcgttggcctgccatccggccgcacgcggccgcgggccgctggtcgtgatgaacgaggatatccatctggcccgtcatgtgcagaaaacggccgcctctggcatcgccgcgttcgcttcgcccaatgcaggccgggccggcgtcatgcagggcggccggccggtgtttcacgcccgcgccgagcgccaggccgccgacgcgctgctcaggccggacgaactgccgcagcaggcctggccgcgggtcgacatcgtgcatgcctgtgtcgatctcgacggcgagctcatcgatttcatggccgggcgagcccagggcatcgtgctggccggcgtgggcgacggcaacgccaccgacgcggccctgcaggccctgcagcgggcctgcgcgcggggcgttgcggtggtgcgggcgtcgcgcaccggctcgggcagggtggggcgcaatatcgagatcgacgacgacgcctgcggcttcattgccgccggcgacctcagcccccagaaggcccgcgtgctgcttaccctgggcctgtgccagacccgcgataccgcgcgcctgcaggcgttggtcgacagccgctga

SEQ ID NO: 1488 - protein, 333 aa, Bordetella parapertussis
MPEARLPRIAVLATGGTIAGAQTDAASGAYRAGSYGVGQLLAAVPQLAGLARIGAEQIANVGSQNMSHAVWRQLALRAAALCDDPATDGIVITHGTDTLEETAYFLSLVLPVDKPVVLLGAMRPATALSADGPVNLYNAVALACHPAARGRGPLVVMNEDIHLARHVQKTAASGIAAFASPNAGRAGVMQGGRPVFHARAERQAADALLRPDELPQQAWPRVDIVHACVDLDGELIDFMAGRAQGIVLAGVGDGNATDAALQALQRACARGVAVVRASRTGSGRVGRNIEIDDDACGFIAAGDLSPQKARVLLTLGLCQTRDTARLQALVDSR

SEQ ID NO: 1489 - DNA, 975 bp, Bacillus cereus (strain ATCC 14579 / DSM 31)
  CDS (1)..(975)
atgaaaagaatcctagttttacacacaggtggaacaattgcaatggaggaagataaagaaactggggtcgtacaaccaggtgaagaaaatcctcttttaaaattcattcctgatttagaagccgatgttgatttaatcgttgaagatgtgttccacctaccatctcctcatatgacaccgagcgaaatgttacaattacaagtcatcattgatgaaagagtaaaacaagacaacattcatggcgtagtcattacgcatggcacggatacattagaagaaacagcttatttcttagatttaacagtacaagcaactattccgatcgtagtgacaggtgcaatgcgctctagcaatgagttaggtgctgatggtctatataacttcttatcagctgtaaaagttgctagttgtgatgaagctgcagaaaaaggtgttttagtcgtattaaacgacgaaattcattgcgctacaaatgtaacgaaaacacatacaagtaatgttgcaacattccaaagcccacaatacggaccaattggaatggtaacaaaacgcggcgttgtcttccatcacgctttagtacatcacgaaacatatacgataaacaaagtgtctaaaaatgtagttgttctaaaagcatatgctggcatggatgatacattattagcagcaatcgaaaatcttcctgtagacggcattgttatcgaagctcttggacaaggtaatctccctccaagaacactacctagtctagaaagattattaaatagaggtattcctgtcgtattagtttctcgctgtttcaacggtatcgttcaagacgtatattcgtatgaaggtggcggtaaacacttaaaagatatgggcattgtattcacatacggcttaaatgcacaaaaagcacgcattaaattacttgttgcattagagaatacaaattctcatgaatccattcaaaatatgtttatgcacgaataa

SEQ ID NO: 1490 - protein, 324 aa, Bacillus cereus (strain ATCC 14579 / DSM 31)
MKRILVLHTGGTIAMEEDKETGVVQPGEENPLLKFIPDLEADVDLIVEDVFHLPSPHMTPSEMLQLQVIIDERVKQDNIHGVVITHGTDTLEETAYFLDLTVQATIPIVVTGAMRSSNELGADGLYNFLSAVKVASCDEAAEKGVLVVLNDEIHCATNVTKTHTSNVATFQSPQYGPIGMVTKRGVVFHHALVHHETYTINKVSKNVVVLKAYAGMDDTLLAAIENLPVDGIVIEALGQGNLPPRTLPSLERLLNRGIPVVLVSRCFNGIVQDVYSYEGGGKHLKDMGIVFTYGLNAQKARIKLLVALENTNSHESIQNMFMHE

SEQ ID NO: 1491 - DNA, 966 bp, Enterococcus faecalis (Streptococcus faecalis)
  CDS (1)..(966)
atgaagaccattttagtccttcatacaggtgggaccatttccatgtcgaaagtagcaggaggaagtgttgccccgaatgaaaaaaatccgttgatggaacaagaagcattattttctggcaaggttcatttagttgttgaagatatttttaatattccctcaccacacatgaccttagaacggatgtttcaattaaaagaacggattcaaaaagcttattctgaaccaattgatggcgtggttattacgcatggaacagatacattagaagaaactgcttattttttagatataaccttagagaaaaaaatccccattgttttaacaggagcaatgcggtcaagtaacgaaatcggtagtgatggcttgtataatttcatcagtgctatttggactgcttgttcagacgaatcgtacgataaaggtgttttagtcgtgatgaatgatgaaattcatacggcgcgttatgtgacaaaaacacatacaacgaacgtagcgacgtttcggacgccaacttttggaccaataggaaccattgcgaaagaacgtgctttttttgcgaaagaggtcttaccgcaagaagtttgcgatgtttcttctgtgaaaggaaatgttcacgtagtgaaggcctatgcggggatgggtgaacggatgtttgaattattaaacaccccagaaacggatgggttagtaattgaagcgctaggcgcgggtaatttaccgccagaaacgctcccagcattacaaaaaatgctagacaacgggattccagtcgttttagtttctcgttgttccaatggcattgctgaagatatctatgattatgctggtggtggcgttggcttgaaaaaaatgggggtcgtttttgcccgtggtttaaacggaccgaaagcgcggattcgtttaattgttggtttaaacagcgaaaaaaatcctgcagagttaaaagaatttttggaacagtaa

SEQ ID NO: 1492 - protein, 321 aa, Enterococcus faecalis (Streptococcus faecalis)
MKTILVLHTGGTISMSKVAGGSVAPNEKNPLMEQEALFSGKVHLVVEDIFNIPSPHMTLERMFQLKERIQKAYSEPIDGVVITHGTDTLEETAYFLDITLEKKIPIVLTGAMRSSNEIGSDGLYNFISAIWTACSDESYDKGVLVVMNDEIHTARYVTKTHTTNVATFRTPTFGPIGTIAKERAFFAKEVLPQEVCDVSSVKGNVHVVKAYAGMGERMFELLNTPETDGLVIEALGAGNLPPETLPALQKMLDNGIPVVLVSRCSNGIAEDIYDYAGGGVGLKKMGVVFARGLNGPKARIRLIVGLNSEKNPAELKEFLEQ

SEQ ID NO: 1493 - DNA, 1065 bp, Vibrio parahaemolyticus
  CDS (1)..(1065)
atgacaaaaaatcttttccgcctcagtacgattacccttggtttgtgcctcagttctttgtcgttcgcccaatccgatcttcctaatatcaaaatcctcgcgactggcggcaccatagctggcgcaggtcaatctgccactgagtcgaactacaccgcaggtaaagttggcgtcgaatcattaatttctgctgtgccgagcatgaccaacattgcggatatttctggtgagcaagtcgtcagcatcggctctcaagacatgaacgatgaggtatggctgaagttagcgaaaagggttaacgagctgctcgctcaagatgatgttgacggtatcgtcatcacccacggtacggatacgttggaagaaaccgcatacttccttgatttaacggtgaagagcgacaagcccgttgtgatcgtgggcgcgatgcgaccatccaccgccatgagtgccgatggcccggtcaatttatacaatgctgttgttactgcaaccgatgaagactcaaaaggccgcggcgtgctagtggcaatgaatgacactattttcgatgcgcgagatgtaacgaagaccaacaccacctcagtaagtacgttccaatcgccaaacttcggccctcttggctacattcacaacagcgatgcaaagtaccaaagaagccctgaacgtaaacacaccacagaaaccccattcgacgtatcaaaactcaacacactacctaaagtaggcattgtttataactatgcgaatgcgtcgagcttgccagtcaaagccttggttgatgccaagtttgacggtattgtgagtgctggtgtgggtaatggtaacttgtaccacacggtctttgatgagctcgaaaaagcgagcaaagatggcattgttgtcgtcagaagctctcgcacgccaactggctcaacgactttggacgcggaaattgatgatgataaatacggctttgttgcatcaggcacgctaaacccacaaaaagcacgtattttgctgatgttgtcactcacgcaaacgaagaactatcaagacgttcagaagatgttccagtactactaa

SEQ ID NO: 1494 - protein, 354 aa, Vibrio parahaemolyticus
MTKNLFRLSTITLGLCLSSLSFAQSDLPNIKILATGGTIAGAGQSATESNYTAGKVGVESLISAVPSMTNIADISGEQVVSIGSQDMNDEVWLKLAKRVNELLAQDDVDGIVITHGTDTLEETAYFLDLTVKSDKPVVIVGAMRPSTAMSADGPVNLYNAVVTATDEDSKGRGVLVAMNDTIFDARDVTKTNTTSVSTFQSPNFGPLGYIHNSDAKYQRSPERKHTTETPFDVSKLNTLPKVGIVYNYANASSLPVKALVDAKFDGIVSAGVGNGNLYHTVFDELEKASKDGIVVVRSSRTPTGSTTLDAEIDDDKYGFVASGTLNPQKARILLMLSLTQTKNYQDVQKMFQYY

SEQ ID NO: 1495 - DNA, 1089 bp, Pseudomonas putida (strain KT2440)
  CDS (1)..(1089)
atgaatgccgcactgaaaaccttcgccccaagcgcactcgccctgctgctgatcctgccatccagcgcctcggccaaagaagccgaaacccaacagaagctggccaacgtggtcatcctcgccaccggcggcaccattgccggcgccggtgccagcgctgccaacagcgccacttaccaggctgccaagctgggcgtcgacaagctcatcgccggcgtgccggaactggccgacatcgccaatgtacgtggcgagcaagtgatgcagatcgcctccgagagcatcagcaatgacgacctgctgaagctgggcaagcgcgtcgccgagctggccgaaagcaaggacgtggacggcatcgtcatcacccacggcaccgataccctcgaagaaaccgccttcttcctcaacctggtagagaagaccgacaagccaatcgtggtggtcggctcgatgcgtccgggtaccgccatgtccgccgacggcatgctcaacctgtacaacgccgtggccgtagccagcgacaagcagtcgcgtggcaagggcgtgctggtgaccatgaacgacgagatccagtccggccgcgatgtgagcaaggcggtcaacatcaagaccgaagccttcaagagcgcctggggcccgatgggcatggtggtggaaggcaaatcgtactggttccgcctgccggccaagcgccatacggtcaattccgagttcgatatcaagcagatcagcagcctgccgcaggtagacattgcgtatggctatggcaacgtcaccgacaccgcctacaaggccctggcacagaacggcgccaaggcgctgatccatgccggtaccggcaacggttcggtatcgtcgcgggtagtcccggcgctgcaagaactgcgcaagaacggcgtgcagatcatccgctcgtcgcatgtcaaccagggtggtttcgtactgcgtaatgccgaacagccggatgacaagaacgactgggtcgtggctcacgacctgaacccgcaaaaagcgcggatcctggcgatggtagcgatgaccaagacccaggacagcaaagagctgcagcggatcttctgggagtactga

SEQ ID NO: 1496 - protein, 362 aa, Pseudomonas putida (strain KT2440)
MNAALKTFAPSALALLLILPSSASAKEAETQQKLANVVILATGGTIAGAGASAANSATYQAAKLGVDKLIAGVPELADIANVRGEQVMQIASESISNDDLLKLGKRVAELAESKDVDGIVITHGTDTLEETAFFLNLVEKTDKPIVVVGSMRPGTAMSADGMLNLYNAVAVASDKQSRGKGVLVTMNDEIQSGRDVSKAVNIKTEAFKSAWGPMGMVVEGKSYWFRLPAKRHTVNSEFDIKQISSLPQVDIAYGYGNVTDTAYKALAQNGAKALIHAGTGNGSVSSRVVPALQELRKNGVQIIRSSHVNQGGFVLRNAEQPDDKNDWVVAHDLNPQKARILAMVAMTKTQDSKELQRIFWEY

SEQ ID NO: 1497 - DNA, 975 bp, Lactobacillus plantarum
  CDS (1)..(975)
atgaagaagattttggtattacacactggtggcaccattgcgatgtcggccgatgaatccggcaatgtgacccccggagatgaaaatcctttagacaattatcagagttcatttggcacggatattgagttagagactgaggacgtctttaacgtgccgtcgccgcacatcaccccggcacggatgttgcagttaaagcaacggatcgataaggccgcacacgaaggggtcgatggggtggttgtgactcacggtacggatacgctagaagaaacggcgtattttctagatcttactttaccgaatgagctccccgttgtgattaccggcgcaatgcggtccgccaatgagattgggtcggatggtctgcataatctcgaaacggcgattcaaacggctagtacaccggatgcggccgaaaaaggtgttttagtggttatgaatgatgaaatccactcggcccgctacgtcactaagacgcatacgaccaacgtggccacttttagaacaccgacttttggcccgattgggttagtcgctaataaaggcattgtcttttttgaatcattactacgatcaacggtttgcccgattcaaacggtcacggataatgtttttctgatcaaagcatatgccgggatgggaccagaactatttgacgccattgcacaacccacgactcatggcgtagtcattgaagcattgggagcggggaatttgccaccggcgacgttaccagctgtgcaaaaattattagacatgcagattccggttgtactggtttcccggtgcttcaacggtatcgctcaggatgtctatgcttatgaaggtggcggtgttcaattgaaacaaatgggtgtgattttttgtcagggattgaatggacaaaaagcccggattaagttactggtgggtgtcagtgccggtatgtcgaccgatgagctagctcgatttgtagcgactgccaattcataa

SEQ ID NO: 1498 - protein, 324 aa, Lactobacillus plantarum
MKKILVLHTGGTIAMSADESGNVTPGDENPLDNYQSSFGTDIELETEDVFNVPSPHITPARMLQLKQRIDKAAHEGVDGVVVTHGTDTLEETAYFLDLTLPNELPVVITGAMRSANEIGSDGLHNLETAIQTASTPDAAEKGVLVVMNDEIHSARYVTKTHTTNVATFRTPTFGPIGLVANKGIVFFESLLRSTVCPIQTVTDNVFLIKAYAGMGPELFDAIAQPTTHGVVIEALGAGNLPPATLPAVQKLLDMQIPVVLVSRCFNGIAQDVYAYEGGGVQLKQMGVIFCQGLNGQKARIKLLVGVSAGMSTDELARFVATANS

SEQ ID NO: 1499 - DNA, 1140 bp, Bradyrhizobium japonicum
  CDS (1)..(1140)
atgacgaagcctaccgccagcccagccagctgtcgccaacgtcgaacatccatgcttgccattccactgctgtcttttgcgctctggtccggcggcatcggcgcagcggcgcacgctgcagagccgggcaaggacgcttcggccggaggcctgccgcgcattctcgtgcttgcgacgggaggcaccatcgcaggccaggctgacgcgcgtgcgaccggtgcgtacaaatcgggccagatcacgggcgagcaattgatgcagtcggtgccgggtctggacaagctggcaaagctgaacgccgaacagatttcgtcgatcggatcccaggacatgaacgacaaggtctggtttgcgctggcccgtcgcattcaggaggccttcgacaagaacgaggccgacggcgtcatcgtgacccacggcacggatacgctcgaggagacggcgttctttctcgacaatgtggtgcgtggcgacaagccggtggtcatcgtcggctcgatgcgtccggcttcagccgtcagcgcggatggccccggcaatctgtacgaagcggtccaggtggccgccgatccccgatcccgcgggcgcggcgtcatggccgtgctgaacgacaagatcgagggagcacgctcggtcaccaagaccaacaccacgagcatcgagacgttcaattctcccaacggcgggccgatcggctatgtcgacaccgcgggcggcatccgtttcatggcccaggctgccggtctcaagcgcgcggcctatcagctcccggcaggcgagcaattgccgcgggtcgagatcgtctactcgcatgccaacatggacgccgttccgatcgaggacgccatttcccacggcgccaaaggcatcgtgctggccggtgtcggtgacggcaatacgtcgaagccggcgctcgatgcgctcgaagcggccgcgaagaaagggatcctcgtcgtccgttccacgcgggttcggtctggcttcgtcacccgcaatgtcgaggtcgacgatgacaagaatggcttcgtcgtgtccgaggacctcaatccccagaaggcacgcgttctcacccaattgctgatcgcgagcggcgtcacggctccggccgagctgcagcgggcttttacagcgacatggtga

SEQ ID NO: 1500 - protein, 379 aa, Bradyrhizobium japonicum
MTKPTASPASCRQRRTSMLAIPLLSFALWSGGIGAAAHAAEPGKDASAGGLPRILVLATGGTIAGQADARATGAYKSGQITGEQLMQSVPGLDKLAKLNAEQISSIGSQDMNDKVWFALARRIQEAFDKNEADGVIVTHGTDTLEETAFFLDNVVRGDKPVVIVGSMRPASAVSADGPGNLYEAVQVAADPRSRGRGVMAVLNDKIEGARSVTKTNTTSIETFNSPNGGPIGYVDTAGGIRFMAQAAGLKRAAYQLPAGEQLPRVEIVYSHANMDAVPIEDAISHGAKGIVLAGVGDGNTSKPALDALEAAAKKGILVVRSTRVRSGFVTRNVEVDDDKNGFVVSEDLNPQKARVLTQLLIASGVTAPAELQRAFTATW

SEQ ID NO: 1501 - DNA, 1059 bp, Bacteroides thetaiotaomicron
  CDS (1)..(1059)
atgaaacaaattaagaaattaggcctggtagtagtaacactactattatccgcaacaatggcatttgccgcaaaaccgaatatccacatccttgctaccggaggaaccattgccggaacaggaagctcggctacgggcaccagctatacggcaggacaagttgctatcggtgcattgctggatgcagtccccgaaatcaaagatatcgccaatgtaaccggcgaacagattgtgagaatcggttcacaggacatgaatgacgaagtctggctgacacttgccaagaaaatcaacgagttattgaaacgaccggatatcgacggaatcgtgatcactcatggaacggatacgatggaagaaactgcttactttctgaatctgactgtcaaaagtgacaagcctgttgtattggtaggtgccatgcgcccctctacagcattaagtgccgacggtccgctgaatctttataatgcagtagttaccgctgcagctaaagaatcaaaagacaaaggtgtactggttgccatgaacggtctgattctaggtgcagaaagcgtagttaaaatgaacacggtcgatgtacagactttccaggctcccaactccggcgcattgggatatgtactgaacggtaaagtatgttataatcagatcacactgaagaaacataccacccaatccgtatttgatgtcaccaaactgacttcattgcccaaagtcggcatcgtatacagctattccaatattgaagccgatatgatgactccgttgctcaacaacggatataaaggaatcattcatgcaggagtcggaaacggtaatatccataaaaacatatttccgtcattgatagacgcccgcagaaaaggcattgtagtcgttcgttcttcccgcgtaccgactggtcctaccactcttgatgcggaagtggatgacgccaagtatcagtttgtagcctctcaagaattgaatccacaaaagtcacgtgtactattgatgcttgcgctgaccaaaaccacggactggaaacaaattcaggaatactttaacgaatactaa

SEQ ID NO: 1502 - protein, 352 aa, Bacteroides thetaiotaomicron
MKQIKKLGLVVVTLLLSATMAFAAKPNIHILATGGTIAGTGSSATGTSYTAGQVAIGALLDAVPEIKDIANVTGEQIVRIGSQDMNDEVWLTLAKKINELLKRPDIDGIVITHGTDTMEETAYFLNLTVKSDKPVVLVGAMRPSTALSADGPLNLYNAVVTAAAKESKDKGVLVAMNGLILGAESVVKMNTVDVQTFQAPNSGALGYVLNGKVCYNQITLKKHTTQSVFDVTKLTSLPKVGIVYSYSNIEADMMTPLLNNGYKGIIHAGVGNGNIHKNIFPSLIDARRKGIVVVRSSRVPTGPTTLDAEVDDAKYQFVASQELNPQKSRVLLMLALTKTTDWKQIQEYFNEY

SEQ ID NO: 1503 - DNA, 969 bp, Staphylococcus epidermidis
  CDS (1)..(969)
atgaaacgtctacttatcatacatactggtggcacaataagtatgtcacaagatcaaactaataaagtgataacgaatgaagaaaatccaatatcacaacatcaaaatatcattagtcaatatgcagaggttgacgaaatcaatcttttaaatataccctcgccgcatatgacaatttcgaatgttgtgcgattaagagacgaaatcattacatattctaaagaaaatatatatgatggatttgtcattactcatggaacagatacacttgaggaaacagcttttttaatagatttattaattgatattcaagagcctatagtaattactggagcaatgagatcatccaatgaaattggttccgatggtctctataattttatttctgctataagggttgcttcttcatctgaggctaatcataaaggtgttatggtcgtatttaatgatgagattcacactgctcgtaatgtgacaaagacacatacttcgaatattaatacatttcaaagtcctaatcaggggcctctaggtgtacttaccaagaatcgagtacaattttatcatcatccttacagacaaactacctaccaatatatcgatgtaaatttacgtgttccacttgtaaaagcatacatgggtatggaagatgatgtactatcattttattcacaacaacacgttgatggtatagtcatcgaagcactaggacaaggtaaccttccaaaaagttgtcttaatggactacagcaatgtctaaagaaaaacattcctctagttctcgtatctagatcattcaatggtattgttagtcctgtatatgcttatgaaggtggtggcgcagatttgaaaaataatggtgttattttttcgaacggtttaaatggaccaaaggcaaggctaaaattactagttggtttgagtcaagacatgactcaaaatcaattagagcgatatttcgaagagtaa

SEQ ID NO: 1504 - protein, 322 aa, Staphylococcus epidermidis
MKRLLIIHTGGTISMSQDQTNKVITNEENPISQHQNIISQYAEVDEINLLNIPSPHMTISNVVRLRDEIITYSKENIYDGFVITHGTDTLEETAFLIDLLIDIQEPIVITGAMRSSNEIGSDGLYNFISAIRVASSSEANHKGVMVVFNDEIHTARNVTKTHTSNINTFQSPNQGPLGVLTKNRVQFYHHPYRQTTYQYIDVNLRVPLVKAYMGMEDDVLSFYSQQHVDGIVIEALGQGNLPKSCLNGLQQCLKKNIPLVLVSRSFNGIVSPVYAYEGGGADLKNNGVIFSNGLNGPKARLKLLVGLSQDMTQNQLERYFEE

SEQ ID NO: 1505 - DNA, 963 bp, Streptococcus agalactiae (serotype V)
  CDS (1)..(963)
atgaaaaaaatccttgttctacacacaggtggaacgatttccatgaatgctaacgagaagggacaggtcatgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggttga

SEQ ID NO: 1506 - protein, 320 aa, Streptococcus agalactiae (serotype V)
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 1507 - DNA, 972 bp, Oceanobacillus iheyensis
  CDS (1)..(972)
atgactaaaaaaatattattattagctactggtggtaccatagcaagtgagaagaaaccaaacagtgatagattagaatctggagtcttgactggagaagaattacttaaacaatgtgatattcctagtggaattgaagtagaggttcattctatatttcaaaaagcaagcatccacttaacatttcaagatttactggtattaaaatcgaaaattgatgaacttttacttaatagtagttttgatggaatagtcattactcaaggtaccgacacattagaagaatcttcatactttatgaatcttattactgattaccatattcccattgtttttacaggttctcagcgttctcctttagaagttggaacggattcttttattaatataaaaaatgcagttctaacggcttgtagtgaagaactaaatgaagtgggtgtgacagttgtatttaatgagcgtatttttcattcacgttatgttcgaaaagaacacgcttcaaatattcagggattcaatgcgtttggatatggatatttagggattatcgataataatcaagtgcgtgttttccaaaagcctacgtataaggattattataaattacaaaagaaattgcctgaagtagatattattaaagtgtatatgaatactgatggtaagtatattaaagcagcgagagataatcaggttgatggaattgtaattgaaggggttggaagaggacaagtatccccaacgatgatgcaagaaattaaacaatgtatcgaagagggtattgcagtggttattacaacatcagctgtagagggagaagtgtatccaacttacgattatcaaggaagtacatatgatttattacagaacggtgtaattcttggaaaagattatgatagtaaaaaagcgagaatcaagctcatggtagggcttgctagtgaaatacctctacagacactttttcatccattctaa

SEQ ID NO: 1508 - protein, 323 aa, Oceanobacillus iheyensis
MTKKILLLATGGTIASEKKPNSDRLESGVLTGEELLKQCDIPSGIEVEVHSIFQKASIHLTFQDLLVLKSKIDELLLNSSFDGIVITQGTDTLEESSYFMNLITDYHIPIVFTGSQRSPLEVGTDSFINIKNAVLTACSEELNEVGVTVVFNERIFHSRYVRKEHASNIQGFNAFGYGYLGIIDNNQVRVFQKPTYKDYYKLQKKLPEVDIIKVYMNTDGKYIKAARDNQVDGIVIEGVGRGQVSPTMMQEIKQCIEEGIAVVITTSAVEGEVYPTYDYQGSTYDLLQNGVILGKDYDSKKARIKLMVGLASEIPLQTLFHPF

SEQ ID NO: 1509 - DNA, 1056 bp, Corynebacterium efficiens
  CDS (1)..(1056)
atgttctatgtgacgtggtgtccgcttttcgtttctggtgtcccagctcgcagggaaagtgcgggaaaagaagaagagaggtgctctatgacccacgtcctcgtcctggcaacgggtgggaccatagcgtcgacagccgggccgtctggatcgggtgccgtcgccaccgaaggtatcgatgcgctcctgaacaaggtggaggtcagtggcatcacggtgagtggacgcaatgtcctcaccaccaattccttcctcctgtcacatcgggacctacggctgattgtcgaggcggtcacagacgcgctgcgggacgagggcgtggacggtgtggtgttgacccacggcaccgacaccatggaggaatcggcctaccttttggacctgatccacgacagtgacaaacccgtggtactcaccggctcccagcgatccaatgatggcattggatacgacggggatatcaacctggtggacgccatcaccgtcgcaggagcccccgaggcgcggggacagggggtcctcattgcattcgccggtgggatccaccctgcccgtggcacccggaaactccacaccattgacccgtcgcccttcggcggcacagggcccctcggctatgtcaccggcggggcggtggggtttcacgccaccgcacgcaggggtccggcacttccgccacccgacaggggcttcgatgacacccgggtggatgttgttgtctcccatcccggagcggacgccaccgccgctcgggcagcggtggcagccggtgccagaggtgtggtcattctgggcaccggtgccggtaacggcaatcaggagatccggtcatgggtggcggaggctgtgagccgggacatcaccgtgggggtcagcttccgcgcggtcggcggtccggttcgtccgctctatggcaacggtggcgcctcggacctggcggacgccggtgccctgttactgggtgacctgccgtggccccaggcccggatcctgctcgcccatctgatctccattcacggcatcgtgtcctcgtcgatggtggctccctatatctga

SEQ ID NO: 1510 - protein, 351 aa, Corynebacterium efficiens
MFYVTWCPLFVSGVPARRESAGKEEERCSMTHVLVLATGGTIASTAGPSGSGAVATEGIDALLNKVEVSGITVSGRNVLTTNSFLLSHRDLRLIVEAVTDALRDEGVDGVVLTHGTDTMEESAYLLDLIHDSDKPVVLTGSQRSNDGIGYDGDINLVDAITVAGAPEARGQGVLIAFAGGIHPARGTRKLHTIDPSPFGGTGPLGYVTGGAVGFHATARRGPALPPPDRGFDDTRVDVVVSHPGADATAARAAVAAGARGVVILGTGAGNGNQEIRSWVAEAVSRDITVGVSFRAVGGPVRPLYGNGGASDLADAGALLLGDLPWPQARILLAHLISIHGIVSSSMVAPYI

SEQ ID NO: 1511 - DNA, 1002 bp, Corynebacterium efficiens
  CDS (1)..(1002)
atgcagcctgacactacgggtcagggcactgttgatagtcttgaccccatgtccgagacctctccagagagcacctctgtgtccaaaattgccgtgatcaccaccggaggcaccatcgcctgcaccgccgatgccgacggccacctcctgcccacggtcagcggcgaggaactcctgcgtcccatcgcggcgcgtttcgacgcctcccagttcaccttcgagatccatgagctcaaccgcctggattcctcctccatgaccttcgccgacatcgacgaactcaatacccggatccatcaggtgttggaggatccggaggtggtcggtgtcgtggtcacccacggcaccgattcgatggaggaaaccgccgtcgcggtggacacgttccacaccgaccaccgtcccgtgatcttcaccggtgcccagaaacccgctgaccatccggaggccgacggcccgggcaatctcttcgaggcctgcctgatcgcctcggatgcctccgcccggggcatcggtgtgctcgtggtcttcggccatgccgtgattcctgcgcgtgggtgcaccaagtggcacaccaccgatgagctggcatttgccaccaatggtcccgaggagccggaacgcccggatcccctgcagctcgctcccctggcggatgtcaccgtggagatcatccccgcctaccccggtgcgtccggcgcatcggtgcaggccgcccttgatgcaggcgcacagggtctggtcgtcgaggcgatgggttcgggcaatgtgggcaccgcgatgggtgcggccctgggccgggcgcttgacgacggcatccccgtggtcatgacgacgcgtgtgccgcgcggtgaggtctccggcacctacggtggcgccgggggcggcgcaaccctggccgcccggggtgcgatcgggtcccggtacttccgtgccggtcaggcgcgcgtcctgctcgcggcggcgatcgccacggggcagcacccggccactctgttctag

SEQ ID NO: 1512 - protein, 333 aa, Corynebacterium efficiens
MQPDTTGQGTVDSLDPMSETSPESTSVSKIAVITTGGTIACTADADGHLLPTVSGEELLRPIAARFDASQFTFEIHELNRLDSSSMTFADIDELNTRIHQVLEDPEVVGVVVTHGTDSMEETAVAVDTFHTDHRPVIFTGAQKPADHPEADGPGNLFEACLIASDASARGIGVLVVFGHAVIPARGCTKWHTTDELAFATNGPEEPERPDPLQLAPLADVTVEIIPAYPGASGASVQAALDAGAQGLVVEAMGSGNVGTAMGAALGRALDDGIPVVMTTRVPRGEVSGTYGGAGGGATLAARGAIGSRYFRAGQARVLLAAAIATGQHPATLF

SEQ ID NO: 1513 - DNA, 990 bp, Brucella suis
  CDS (1)..(990)
atgtctttaatttctatcggccccctcgggggtacgattgcgatggttgaggggggaagcggaggcggtgttgtgccgaccctgaccgcggatgcactcattgccgctgtgccgcagattagaaattatgcgcagatcaaggcccaatctctttttcagcttcccagcccctcgctaaaatttcggcacggccttgaagtgataggctgggctgaaaacgaggtgaaatcgggagcggacggcatagtgctgacgcagggaaccgatacgcttgaggaaatggcattccttctggatttattgtgggaacatccgcagcccctcgtactgaccggcgccatgcgctcgccgcgcgcgccgggtgctgacggtccggccaatctggtggcggccgtattgacagccgcgagcaggcttagccgggaacgcggtgtccttgttgcaatgaacgatacaatccacgcggcacgttggataacaaaatctcatgcgctcagtgtccagacattcgtatcgtcggacagcgggccgttgggatatgtgtatgaggagacgccggtttacatcaacaccctttcgcggttgccaaaaattgaccgtacgcagttcaacgccgatgtgaagatcggcttttacgaatcgctgctggatggtgacgcgcagatgctgcgaagcatgtttgagagcggcagatatgatggaatcgtcgtcgcctgttttggagcaggacatgtgtcgggcgacgaagccgacattatcgagcgctatgcgtcccgcattccggtcgtcgtagccagccggacctatggcggaaggaccgccacgaagacttatgggttccatggctccgagattgatcttcagacgaaaggcgctatgctcgcaggctggttatccccccgcaaggcgcggttattgctgtgggcactactggcagcgggtaaaaatctggaagaaacaagagctaacttcctgctctataacccataa

SEQ ID NO: 1514 - protein, 329 aa, Brucella suis
MSLISIGPLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVACFGAGHVSGDEADIIERYASRIPVVVASRTYGGRTATKTYGFHGSEIDLQTKGAMLAGWLSPRKARLLLWALLAAGKNLEETRANFLLYNP

SEQ ID NO: 1515 - DNA, 999 bp, Brucella suis
  CDS (1)..(999)
atgaagacaggcaggacggatcgccccagaattctcatcgtttccaccggcggaaccatcgcctcgcgttacgatccgcaaacggattcgctgttgagcgtttcgaccggaaacgaacttctatcctctctcggtgcgcttgcccctgcagtcgatgttgttcttgacgaattctgcaatcttggcagcaaccgcatcgatctcgatacatctttcaggcttgcgcatcatattgatgaacggctcagggaccgaaccgtcgacgggtgtgtggtcacacacggcacggacacgctggaggaaagcgcattcctcgcacagcttacgatatcctcgcgaaagccggtggtctttaccggagcccagcgcagcgcagacgaaccggatgccgacggaccacgcaatcttgccgacgcaatctccgttgccgcctcgcccgaggctcgcgatctcggcacgctcgtcgtcttcgccgggaaggtgctctcctctatcgacgcgacaaaaattcatacgtcgaagctcgaagcctatgatgcccccggatatgggccgctcggcgtggtggatcacggcgcggtattcatcacaagaaaaccgctgggctatccgatgattgccgcccattcgatcgaaactcgggtcgatctcatcacactcgcgatgggtgccgatggccgtctcatcgaagcggcgatcaattccggcacacacggcttcattctggaaacattcggccggggcaacgccacgcccgcagttgtcgatgccgtcgcccgagcaacggaacggggcatcgtaacaatcatcacctcgcgctgcccggatggccgggtgctgcctgtctacggcgatggaggcggaagcgaccttgaaaaggccggagcaatcttcgccggtcggctgaacggccccaaagcacgaattctcctttgtctgtcattgccaaccatccctgttgaggagctaggccgcctttttgagcagtttggacgataa

SEQ ID NO: 1516 - protein, 332 aa, Brucella suis
MKTGRTDRPRILIVSTGGTIASRYDPQTDSLLSVSTGNELLSSLGALAPAVDVVLDEFCNLGSNRIDLDTSFRLAHHIDERLRDRTVDGCVVTHGTDTLEESAFLAQLTISSRKPVVFTGAQRSADEPDADGPRNLADAISVAASPEARDLGTLVVFAGKVLSSIDATKIHTSKLEAYDAPGYGPLGVVDHGAVFITRKPLGYPMIAAHSIETRVDLITLAMGADGRLIEAAINSGTHGFILETFGRGNATPAVVDAVARATERGIVTIITSRCPDGRVLPVYGDGGGSDLEKAGAIFAGRLNGPKARILLCLSLPTIPVEELGRLFEQFGR

SEQ ID NO: 1517 - DNA, 978 bp, Corynebacterium glutamicum (Brevibacterium flavum)
  CDS (1)..(978)
atgtcgaagcagcactccacaccattaaacaatgatgaagaacacacttccgctcctcaaaaggttgcggtaatcaccacgggcggaaccatcgcctgtacttccgacgcaaatgggcatctgcttcccaccgtcagcggtgcagacctgcttgcgccaatcgcaccacggttcaatggagcgcagatcgctttcgaaatccacgaaatcaaccgccttgattcctcctccatgacgtttgaggatctcgattccatcatcgccacggttcataaggtgttggaggatccggatgttgttggcgtagtagttacccacggcaccgattccatggaagagtccgccatcgccgtagacaccttccttgatgatccccgcccagtcattttcaccggcgcccaaaaacccttcgatcatcccgaagccgacggcccaaacaaccttttcgaagcctgcctcatcgcatccgacccctccgctcgcggaattggtgcactcattgtcttcggtcacgccgtcatccctgctcgcggctgcgttaaatggcacacctctgatgagctggcgtttgcaaccaacggccctgaagaaccagagcgccccgatgcgctgcccgtagctaaattggcggatgtctctgtcgaaatcatccccgcataccctggtgccaccggcgcaatggtggaagctgccatcgctgccggtgctcaaggacttgtagtggaagcaatgggatcaggcaatgttggttcccgcatgggtgatgccctaggtaaagcacttgacgctggaattcccgtggtgatgagcactagggttcctcgtggtgaagtatccggagtgtatggcggtgcaggtggaggtgcgactttggctgcgaagggcgctgtgggatctcgctacttcagagctggtcaggcacgtattttgctcgcgattgccattgcgacgggcgcacatccggtgacgctttactag

SEQ ID NO: 1518 - protein, 325 aa, Corynebacterium glutamicum (Brevibacterium flavum)
MSKQHSTPLNNDEEHTSAPQKVAVITTGGTIACTSDANGHLLPTVSGADLLAPIAPRFNGAQIAFEIHEINRLDSSSMTFEDLDSIIATVHKVLEDPDVVGVVVTHGTDSMEESAIAVDTFLDDPRPVIFTGAQKPFDHPEADGPNNLFEACLIASDPSARGIGALIVFGHAVIPARGCVKWHTSDELAFATNGPEEPERPDALPVAKLADVSVEIIPAYPGATGAMVEAAIAAGAQGLVVEAMGSGNVGSRMGDALGKALDAGIPVVMSTRVPRGEVSGVYGGAGGGATLAAKGAVGSRYFRAGQARILLAIAIATGAHPVTLY

SEQ ID NO: 1519 - DNA, 969 bp, Staphylococcus aureus (strain MW2)
  CDS (1)..(969)
atgaaacatctacttgttattcatactggtggcaccattagtatgtcacaagaccaatctaataaagtagtaacaaatgataccaaccctatttcaatgcatcaagatgtcataaatcaatatgcacaaatagatgaattaaatccttttaatgtaccatcacctcatatgacaatccaacatgttaaacaattaaaggatattattttagaagcagtaacaaataaatattatgatggtttcgttatcacgcatggtaccgatacgttagaagaaactgcctttttacttgatttaatattaggtatcgagcaacctgttgttattactggcgcaatgcgctcgtctaatgaaattggttctgacggattatataattatatttccgctattcgcgttgcctctgatgaaaaggcccgtcataaaggcgtgatggttgtatttaatgatgaaattcatacggcgcgtaatgttaccaaaacacatacgtctaatacaaacacatttcaaagtccaaatcatggtccgctaggtgtattgacaaaggatcgtgtgcaattccatcatatgccatatcgccaacaagcattggaaaatgtcaatgacaaactaaatgtaccattagtaaaagcatatatgggtatgccaggtgacatttttagtttttatagtcgagaaggtatcgatggtatggttattgaagcgttaggacaaggcaacatacctccaagcgcattagaaggcattcaacaattagtatctttaaatatacctattgtgctagtttcacgttcctttaatggtattgtgagtccaacttacgcatacgatggtggtggttaccaactcgcacaacaaggttttattttttctaacggtttgaatggtccaaaagcaagattaaaattattagttgcgttaagcaacaatttagataaagctgaaatcaaatcatattttgaattataa

SEQ ID NO: 1520 - protein, 322 aa, Staphylococcus aureus (strain MW2)
MKHLLVIHTGGTISMSQDQSNKVVTNDTNPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGLNGPKARLKLLVALSNNLDKAEIKSYFEL

SEQ ID NO: 1521 - DNA, 978 bp, Thermoanaerobacter tengcongensis
  CDS (1)..(978)
atgggtaaagtggctgtgatttttacaggtggaaccatagcgatgaagcaagaccccaatctgaaaggggcagtcccttccctcacgggaaaagacctgcttgaaattattcctcacagagaaaacgttttagaaattgaaactatagaatttggaaactaccctagtcctcatctcacagtagaacttttggaagaattaagagaagtcgtagagaagacccttaaaagagatgaaataaaaggagttgtgataacccacggcactgatacattagaagaaacagcttattttttagagctcaccacaaattttgacaaacctattgtcttaactggcgcaatgaaaaattcctctgaagcaggttatgatgggccttccaatttaattgactctctcaccacagcctcttcagaaaaatccaaaaaaagaggcgtgttagtagtgctaaacggtgaaattcattctgcaaaagatgtaacgaaaacccatacttcaagtcttgacacttttaaaagccctgaaacaggtcctctggggtatgtggacagtggcaatgtgtatttttatagaaacgtagaaaaaaggcagtacattcccacaaaaaaactggaacgtcgcgtaagccttttaaaagtagtgtttggaatggatgacaaactgataagatttttagtagaaaatggagaaagaggcattgtcattgaagggacgggcagaggaaatgtgcctccaaaagtagcagaaggaataaaatacgctatatctaaaggaacagttgtagttctcgtatcaaggtgcccgatgggaagagtacatccttcctatgcttatgaaggaggaggaaaacacctcgaatctctgggggtaatttttggaggaaatctatcaggtcaaaaggcaagagtaaaattaatggcagcactggcatacacatcagattacagaaaaattagagagatttttgaggaagagtaa

SEQ ID NO: 1522 - protein, 325 aa, Thermoanaerobacter tengcongensis
MGKVAVIFTGGTIAMKQDPNLKGAVPSLTGKDLLEIIPHRENVLEIETIEFGNYPSPHLTVELLEELREVVEKTLKRDEIKGVVITHGTDTLEETAYFLELTTNFDKPIVLTGAMKNSSEAGYDGPSNLIDSLTTASSEKSKKRGVLVVLNGEIHSAKDVTKTHTSSLDTFKSPETGPLGYVDSGNVYFYRNVEKRQYIPTKKLERRVSLLKVVFGMDDKLIRFLVENGERGIVIEGTGRGNVPPKVAEGIKYAISKGTVVVLVSRCPMGRVHPSYAYEGGGKHLESLGVIFGGNLSGQKARVKLMAALAYTSDYRKIREIFEEE

SEQ ID NO: 1523 - DNA, 984 bp, Clostridium perfringens
  CDS (1)..(984)
atgaagaaaatagctgtaatttttaatggtggaacaatatcaatgaaagttgatgatagaataaaggctgcagttccaagtttgacaggagaggaaataatggctatggtaacaggaatagaaagctttgcaacaatagagtcacatagcttttcttcattaccaagtccacatattactccagagataatgcttgaactatcaaaatttataaatgctttagtagagagagaagatatagatggagttgtagtaactcacggaacagatactctagaagaaacatcttattttgttaatttaacaactaagacaagtaaaccaatagtgtttactggagctatgagaagtggatcagagttaggatatgatggaccagctaacttagctgcatcaatatgtacagctgcatcagatgaagcaaaaaatagaggagttctagtttgttttaatggggaattaaatagtgcttcagaggtaactaaggctaattcaatggctttaaatgcttttagaacacctaattttggcccaataggaatagttgataataatagggtaatatttgatagaagagttccacaggaagattttatacctttagaggttattgataaaaaagtagccataataaaatgtgctgcaggtatggatggagattttatatatcactgtatagagaaaaaatatgatggaatcataatagaagctttaggaagaggaaatgtaccaccaactatggttgatgcaataaaagatgccttagataagggaatagttatagtacttacttcaagatgttttgaaggaagagtaagtgatagctatggatatcttggaggtggaaaaaatcttaaagagctcggggttatatttggagaaagtatgccaagtcaaaaggctagaataaagcttttaactcttcttggatttaataaagattatagatatattaaacatagttttgagaaagaaagatattaa

SEQ ID NO: 1524 - protein, 327 aa, Clostridium perfringens
MKKIAVIFNGGTISMKVDDRIKAAVPSLTGEEIMAMVTGIESFATIESHSFSSLPSPHITPEIMLELSKFINALVEREDIDGVVVTHGTDTLEETSYFVNLTTKTSKPIVFTGAMRSGSELGYDGPANLAASICTAASDEAKNRGVLVCFNGELNSASEVTKANSMALNAFRTPNFGPIGIVDNNRVIFDRRVPQEDFIPLEVIDKKVAIIKCAAGMDGDFIYHCIEKKYDGIIIEALGRGNVPPTMVDAIKDALDKGIVIVLTSRCFEGRVSDSYGYLGGGKNLKELGVIFGESMPSQKARIKLLTLLGFNKDYRYIKHSFEKERY

SEQ ID NO: 1525 - DNA, 1104 bp, Ralstonia solanacearum (Pseudomonas solanacearum)
  CDS (1)..(1104)
atgcttgccaacaggacgccggcccttgcgccggcgtttttcatttggcgcgaaagcgcggcgggcggatacaatgcgccgcgtcacaatttcctgcttgtcgcgccgatgtcctcgttgcccactatcgccattctcgccaccggcggcaccattgccggctcggcggacgattccgcttccgcggcccgctatcgtgccggtgccgtgcccatcgaccagttgctggcagccagcaagctgggcctggaacgcatcgccaacgtgcgcgccgagcaggtcgcgcagatcgacagcaaggacctgaccttcgacgtgtgggagcgtctggtggcgcggatccgtcactggatcgatgtggagcgtgtggacggcgtggtcatcacgcacggcaccgacacgctcgaggaaaccgcgatgctgctgcacctggtgttgcagactgacatgcccatcgtcatgaccgcggcgatgcggccgtcgacgtcgttgtcggcggatggtccgctgaacctgctcaatgccgtgcgcgcagccgccagccctgcctcgcgcgggcgtggcgtgctggtggccctgaatcagcgcgtccatgcggcgcgcgacgtgcagaaggggcacacctacgctgtcgaggcgtttgtgtcgccggacgtcggtccgcttggcttcgtgctggacgccgcagtgcaataccagcgcgccgcccagctgccggccgcggctgacgggctgccgatgccggctgtcgggcaatggccgtgggtcgaggtgctgtcgagctacgctcagcccgatgcgcgcctggtcgacgctctggtggaggccggtgtgcgcgggctggtcattgccgcgacgggggcggggtccatccacgtcaatctggaagctgcgctgcagcaggcggtcaagcagggcgtgattgtgctgcgttcgacccggactggggccggcgtggtgccggcgcatcccgacgggcagggctgggcatcgtccgggacgctcaacccgtacaaggcgcgcgtgcttctgatgctgctgattgccgccggccatgcccaggcagaaacggcctccctgcagcaagtcattgatcgatattga

SEQ ID NO: 1526 - protein, 367 aa, Ralstonia solanacearum (Pseudomonas solanacearum)
MLANRTPALAPAFFIWRESAAGGYNAPRHNFLLVAPMSSLPTIAILATGGTIAGSADDSASAARYRAGAVPIDQLLAASKLGLERIANVRAEQVAQIDSKDLTFDVWERLVARIRHWIDVERVDGVVITHGTDTLEETAMLLHLVLQTDMPIVMTAAMRPSTSLSADGPLNLLNAVRAAASPASRGRGVLVALNQRVHAARDVQKGHTYAVEAFVSPDVGPLGFVLDAAVQYQRAAQLPAAADGLPMPAVGQWPWVEVLSSYAQPDARLVDALVEAGVRGLVIAATGAGSIHVNLEAALQQAVKQGVIVLRSTRTGAGVVPAHPDGQGWASSGTLNPYKARVLLMLLIAAGHAQAETASLQQVIDRY

SEQ ID NO: 1527 - DNA, 1044 bp, Salmonella typhimurium
  CDS (1)..(1044)
atgaaaattagagttttcatggccaccgtgttgctgctcatcagccactgtgtatttagcacaacgtcactaccgcatattgttattctcgcgacaggtggtactatcgccgggacggcagccaataatacgcaaaccgccggatataaatctggtgaacttggcgtgcaaacattaataaatgccgtgccggaaatgaataatatcgctcgcgttgacggcgagcaggtggcgaatattggtagcgaaaatatgaccagcgatatcatcctgaaactttcacagaaggtgaatgcgttattggcgcgggacgatgttgacggtgtggttattactcatggcactgacacgctcgatgaaaccgcctactttcttaatttgaccgtgaaaagcgacaaaccggtggtgtttaccgctgcaatgcggcccgcgtcggcaatcagcgccgatggcgcaatgaacctgctggaagcggtcacggtggctgctgacccgaatgcgaagggacgcggtgtgatggtggttttaaacgatcgtattggttcggcgcgctttgtgacgaaaactaatgccacgactctggatacctttaaagcgccggaagagggctatctgggggtcatcgttaatggtcagccacagttcgaaacgcgggtggaaaaaattcataccctgcgatctgtttttgacgtacgtaatatcaaaaaattacccaatgtggtgattatttacggctatcaggacgacccggaatatatgtatgatgcggcgatcgcccatcacgcggacggtattatttatgccggaaccggcgcaggttcggtctcggtacgcagcgacgcggggattaaaaaagcggagaaagccgggattatcgtggtgcgcgcttcccgcaccggaaacggcgtcgtaccgttggataaagggcagccagggctggtgtctgactcgctcaacccggcgaaggcgcgagtcttgctgatgacggcattaactcagacgcgtaatccggaactgatccagagttatttcagtacgtattaa

SEQ ID NO: 1528 - protein, 347 aa, Salmonella typhimurium
MKIRVFMATVLLLISHCVFSTTSLPHIVILATGGTIAGTAANNTQTAGYKSGELGVQTLINAVPEMNNIARVDGEQVANIGSENMTSDIILKLSQKVNALLARDDVDGVVITHGTDTLDETAYFLNLTVKSDKPVVFTAAMRPASAISADGAMNLLEAVTVAADPNAKGRGVMVVLNDRIGSARFVTKTNATTLDTFKAPEEGYLGVIVNGQPQFETRVEKIHTLRSVFDVRNIKKLPNVVIIYGYQDDPEYMYDAAIAHHADGIIYAGTGAGSVSVRSDAGIKKAEKAGIIVVRASRTGNGVVPLDKGQPGLVSDSLNPAKARVLLMTALTQTRNPELIQSYFSTY

SEQ ID NO: 1529 - DNA, 966 bp, Streptococcus pyogenes
  CDS (1)..(966)
atgaaaaaaatcctagtcttacacactggtggaaccatttctatgcaagctgataactctggtagggttgttccaaatcaagataatcctatgacgaaaatacatgctgcagcccaagatattcagcttaccgttagtgattttctaaatcttccgagtcctcacatcacgcctcaccacatgttatctatttatcatcatattcaagaaagaactgatgtctttgatggtatagtcatcacacatggaacagataccttagaagaaacagcttattttttagataccatggcattgcctactaatatacctgttgtcctaacaggtgctatgaggtcttctaatgaagttggtagtgatggcatatataattaccttaccgcacttagagttgcaagtagtgataaagctaaagaaaaaggggtacttgttgttatgaacgatgaaatccatgctgctaaatatgttactaaaacacatacaaccaatatttcaactttccaaacacccacacacggaccgcttggtatcatcatgaaaaatgacctactttttttcaaaactgctgaacctcgtattcgttttgacttgagatgcatttctggaaccatccccattatcaaagcatacgcaggtatgggcgatggtagtatcttgagtctattaactccaggtagcattcaaggtctagttatcgaagctctaggggcaggaaatgtcccaccattagcagttggggagatcgagcacttaattgctttaggtattcctgtcattcttgtttcccgttgtttcaatggtatggcagaacctgtctatgcttatgaaggtggtggtgcgatgctacaagaagcaggtgttatgtttgtaaaagaattgaatgctccaaaagcccgtctaaagttattaattgctctcaacgccggacttactggtcaagagctaaaagattatattgaaggatga

SEQ ID NO: 1530 - protein, 321 aa, Streptococcus pyogenes
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLIALGIPVILVSRCFNGMAEPVYAYEGGGAMLQEAGVMFVKELNAPKARLKLLIALNAGLTGQELKDYIEG

SEQ ID NO: 1531 - DNA, 969 bp, Deinococcus radiodurans
  CDS (1)..(969)
atgcctgcttctctgccgcgcctcgccctgattcacaccggcggcaccatcgccagccggcccagtcccgacggacgcgggctgacgccgcaaacgccccccgcgctgccggggctggaaggagtgcaggtcagcgaacaccagccgttcaacctgccgagtccgcacgtcacgcccgcgcacatgcagcagctcgcgcacctcatcgagcagctcgccgggggccacgacgcggtggtggtcacgcacggcaccgacacgctggaagaaacggcctttttcctgcacctgtgcctgcccgctgggctgccggtggtgctgaccggctccatgcgccacgccgaggaagtctcctgggacggccccggcaacctgctcgacgccgcgcaggtcgcgctgtgcccgcagacggcggggcgtgggccgctcgtcgtgtttggcggggacatcttcgacgcccgcaccgtgacgaaggtgcacaccagcgcggtggacgcgttcggcggctatcccggtcccatcgggcgcatcgaccgcaccgccgccgggccgcaggtccactattttgcccggcccgaaccgcgccccactttccgcccggtcacgctggagcggcgggtggagattctctatgcctatgccggctggcagggcgagggctacgccggggcgctggagcgggccgacggactggtgattgccgcgctcggcaccggcaacctgccgcccgaactgctgccactcattgccgcgaccgacaagccggtggtgctcgctacccgcacccacgccgggccgattttgccggtgtacggctacgcgggcggcggcgcgacgttggtggaagcgggcgcgattcccgccagttttctcaacgcgcacaaggcgcggctgctgctgctggtgctgcttaacctgggagcgtcgcgcgaagatatccggcgggtctttacgcagggcgtcttctga

SEQ ID NO: 1532 - protein, 322 aa, Deinococcus radiodurans
MPASLPRLALIHTGGTIASRPSPDGRGLTPQTPPALPGLEGVQVSEHQPFNLPSPHVTPAHMQQLAHLIEQLAGGHDAVVVTHGTDTLEETAFFLHLCLPAGLPVVLTGSMRHAEEVSWDGPGNLLDAAQVALCPQTAGRGPLVVFGGDIFDARTVTKVHTSAVDAFGGYPGPIGRIDRTAAGPQVHYFARPEPRPTFRPVTLERRVEILYAYAGWQGEGYAGALERADGLVIAALGTGNLPPELLPLIAATDKPVVLATRTHAGPILPVYGYAGGGATLVEAGAIPASFLNAHKARLLLLVLLNLGASREDIRRVFTQGVF

SEQ ID NO: 1533 - DNA, 1089 bp, Pseudomonas fluorescens
  CDS (1)..(1089)
atgaaatctgcactgaaaaccttcgttccgggcgccctagccctactgctgctgttccccgttgctgcccaggcaaaggaagtcgaaaccaagaccaagctggccaacgtggtgattctcgccaccggcgggaccattgccggcgccggcgccagcgccgccaacagcgccacctaccaggcggccaaggtcggtatcgagcaattgatcgccggtgttcctgagcttagccagatcgccaatgtccgcggcgagcaagtgatgcaaattgcgtccgagagcatcaacaacgaaaaccttctgcagttgggtcgccgagtagccgaactggctgacagcaaggacgtggacggcatcgttatcacccacggtaccgacaccctcgaagaaaccgcttacttcctgaaccttgtggaaaagaccgacaagccaatcatcgtcgtcggttcaatgcgtcctggtaccgccatgtcggctgacggcatgctcaacctgtacaacgccgtggctgtcgccggcagcaaagacgctcgcggcaagggtgtactggtcaccatgaacgatgagatccaatcgggtcgcgacgtcagcaaaatgattaacatcaagaccgaagcattcaaaagcccgtggggcccgttgggcatggtcgttgaaggcaaatcctattggttccgcttgcctgccaagcggcacaccatggattccgagttcgacatcaagaccatcaaaagcctgccagacgtggaaatcgcctacggctacggcaacgtgagcgacaccgccgtcaaggccctggcccaggccggtgccaaagccatcatccatgccggcaccggcaatggttcggtgtcttccaaagtcgtccctgccctgcaggaactgcgcaagcaaggcgtgcaaatcattcgctcttcccacgtgaatgccggcggtttcgttctgcgtaatgctgaacagcctgacgacaagtacgactgggttgtcgcacacgaccttaacccacagaaagcccgcattctggcaatggttgccctgaccaagacccaggacagcaaagaattgcaacggatgttctgggaatattga

SEQ ID NO: 1534 - protein, 362 aa, Pseudomonas fluorescens
MKSALKTFVPGALALLLLFPVAAQAKEVETKTKLANVVILATGGTIAGAGASAANSATYQAAKVGIEQLIAGVPELSQIANVRGEQVMQIASESINNENLLQLGRRVAELADSKDVDGIVITHGTDTLEETAYFLNLVEKTDKPIIVVGSMRPGTAMSADGMLNLYNAVAVAGSKDARGKGVLVTMNDEIQSGRDVSKMINIKTEAFKSPWGPLGMVVEGKSYWFRLPAKRHTMDSEFDIKTIKSLPDVEIAYGYGNVSDTAVKALAQAGAKAIIHAGTGNGSVSSKVVPALQELRKQGVQIIRSSHVNAGGFVLRNAEQPDDKYDWVVAHDLNPQKARILAMVALTKTQDSKELQRMFWEY

SEQ ID NO: 1535 - DNA, 993 bp, Wolinella succinogenes
  CDS (1)..(993)
atggctaaaccccaagtgactatcctagccacaggaggcaccatcgctggttcgggggaatctagcgtcaagagtagctactctgctggagcagtcaccgttgataagcttcttgcagccgtccctgccatcaacgacctagccaccatcaagggtgaacagatctcaagcattggctcccaagagatgacgggtaaggtgtggcttaaactagccaagcgtgtcaatgagctcctcgcccaaaaagagaccgaagccgtgatcatcacccatggaactgacaccatggaagagaccgctttcttcctcaacctcacggtgaaaagccaaaaacctgtcgtccttgtaggcgccatgcgtccaggctcttccatgagtgctgatggccccatgaatctctataacgccgtgaatgtagcgatcaacaaagcctctactaacaaaggagtggtgattgtgatgaacgatgagattcacgccgccagagaagcgaccaagctcaacaccaccgcagtcaatgcatttgcttcgcccaacacaggtaaaatcggcacagtctattatggcaaagtcgagtatttcactcaatccgttcgacctcacacccttgcaagtgagtttgatattagcaaaatcgaagaactccccagagtcgatattctttacgctcaccccgatgatactgatgttttagtcaatgcagcccttcaggcaggagccaaaggaatcatccatgcaggcatgggcaatgggaaccctttccctttgactcaaaatgctcttgaaaaagcagccaaatcaggcgtagtcgtcgctcgaagctctagagtgggcagtggttccaccacccaagaggctgaagtggatgataagaaacttggttttgtggctacagagagtctcaaccctcaaaaagccagagtgcttcttatgttagccctcaccaaaactagtgatagagaggcgatccaaaagatcttctccacctattaa

SEQ ID NO: 1536 - protein, 330 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRPGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 1537 - DNA, 1275 bp, Methanosarcina acetivorans
  CDS (1)..(1275)
atggaattcaaacagggcgattgggtacgcattgaaaggaacggtactgtctatgaaggcaaagtaatgccttccatggaaggatatatcacaataaaaatgaaaagcgggtataacgccggtttttccattgataaggtcaggataacccttctggaaaataacggggaaactgcaaacggaagcagaaacggcggaaaaggctgtaaaactaacgaagaagaacttcccgaacccggaaaaaagctcccgaaaatcgcaatcctttctacgggcggaacgattgccagcaagatcgactaccgtacaggtgcagtcacatcccagtttactgctgacgatatccttgccgcaatcccggaactgaaggaaattgcggacttcaaaggcagggtaatctcaagcatcctctcagaaaacatggactctgactcctggcaaaacctttcaaaagccgttgtggaagagatcgaagccggagctgatggagtaatcgtcactcacgggacagacacaatgatgtattcggctgcagccctttccttcatgatcaaaactcccgtacccatcgtttttgttggttcccagaggagtgcggaccgcccgagcagcgacaacgccatgaacgcaatctgtgcagcccgggtcgccataagcgacattgccgaagtcgtggtggttatgcatggcacaacctctgatgatttctgtgaaatccaccgcggaacgaaggtcaggaagctgcatacctcccgtagggacgcttttaagtccgtaaattccctcccggtagggaccgtagactacggtacaggagaaataaagacatttattgactacacccgacgcggagaaaaggccctgaaattcaagccgggaatggaacctaagtgtgcccttgtgaagttcactccgggagcggaccccacagtccttgactactatataagtaacggctacaaagggcttgttgtcgaaggaacaggcctcggccacatttccacaaaatggattcccctgctccggaaagctacggacgcaaaaatgcccgtaatagttacctcccagtgccttaacggcaggatctgcgaccgcgtctatgataccggcagagatatgctgaaggccggggcaatcgaaggagaagatactcttcccgaaactgcccttgtcaagctaatgtgggtacttggccagaccgatgatttcgaaaaagccgccggcatgctcagggaagacctcagcggggaaattaccgagtgcacgcagagataa

SEQ ID NO: 1538 - protein, 424 aa, Methanosarcina acetivorans
MEFKQGDWVRIERNGTVYEGKVMPSMEGYITIKMKSGYNAGFSIDKVRITLLENNGETANGSRNGGKGCKTNEEELPEPGKKLPKIAILSTGGTIASKIDYRTGAVTSQFTADDILAAIPELKEIADFKGRVISSILSENMDSDSWQNLSKAVVEEIEAGADGVIVTHGTDTMMYSAAALSFMIKTPVPIVFVGSQRSADRPSSDNAMNAICAARVAISDIAEVVVVMHGTTSDDFCEIHRGTKVRKLHTSRRDAFKSVNSLPVGTVDYGTGEIKTFIDYTRRGEKALKFKPGMEPKCALVKFTPGADPTVLDYYISNGYKGLVVEGTGLGHISTKWIPLLRKATDAKMPVIVTSQCLNGRICDRVYDTGRDMLKAGAIEGEDTLPETALVKLMWVLGQTDDFEKAAGMLREDLSGEITECTQR

SEQ ID NO: 1539 - DNA, 1278 bp, Methanosarcina mazei (Methanosarcina frisia)
  CDS (1)..(1278)
atggaattcaaacagggcgatcgggtacgcattgaaaagaacggcactgtctatgaaggcaaagtaatgccttccatggagggatatatcacaataaaaatgaaaagcggttacaacgccggtttttccatagataaggtcagtataactcccctggaaaataacggggaagctgcaaacggaggaaatgggggaaaaaacgggcaaaaagagcctgagccggcaaaagaaaaagtttctaaacctgggctcccgaaagtttctatcctttccacaggagggacaattgccagcaaaatagactacaggacaggtgcggttacatcccagtttactgcggacgatatcctcgctgcaattcctgaattgaaagaaattgcagactttaaagggagggcaatctcaagcatcctttccgaaaacatggaccctgattcctggcaaaacctcgccagagcagtcgttgaagaaatcgaagccggagctgatggaataattgtcactcacgggacggacaccatgatgtattctgctgcagccctttcttttatgatagaaactcctgtgcctatcgtttttgtaggttcccagagaagcgcagaccgccccagcagcgacaatgccatgaatgccatctgtgcagcaagggttgccataagcgatattgccgaagttgtggtggttatgcacggcacaagctcggatgactactgtgaaatccatagagggacaaaggtcaggaaaatgcatacctcccgcagggacgctttcaagtcagtgaattctcttccgatagggacagtggattacgatacaggagaaataaagacatttatcgaatacaccggacgcggagaaaagtccctgaaattcaaacccggaatggaaccgaagtgcgccattgtgaagtttactcccggagcggacccctcagtccttgactgttatgttgacggcggctataaggggcttgtccttgaaggtaccggcctggggcacgtttccacaaaatggattccttttatccggagagctgtggacgcaaaaatgcctgtaatagtcacatcccagtgccttaacggcagggtttgtgaccgtgtttacgatacaggccgtgacatgctgaaagccggtgcaatcgaaggagaagacactcttcccgaaacagcccttgtaaagcttatgtgggtactcggtcagacagatgagtttgaaaaagctgtcagtatgctcggagagaatctcagcggggaaatcaatgagtgcactctgagataa

SEQ ID NO: 1540 - protein, 425 aa, Methanosarcina mazei (Methanosarcina frisia)
MEFKQGDRVRIEKNGTVYEGKVMPSMEGYITIKMKSGYNAGFSIDKVSITPLENNGEAANGGNGGKNGQKEPEPAKEKVSKPGLPKVSILSTGGTIASKIDYRTGAVTSQFTADDILAAIPELKEIADFKGRAISSILSENMDPDSWQNLARAVVEEIEAGADGIIVTHGTDTMMYSAAALSFMIETPVPIVFVGSQRSADRPSSDNAMNAICAARVAISDIAEVVVVMHGTSSDDYCEIHRGTKVRKMHTSRRDAFKSVNSLPIGTVDYDTGEIKTFIEYTGRGEKSLKFKPGMEPKCAIVKFTPGADPSVLDCYVDGGYKGLVLEGTGLGHVSTKWIPFIRRAVDAKMPVIVTSQCLNGRVCDRVYDTGRDMLKAGAIEGEDTLPETALVKLMWVLGQTDEFEKAVSMLGENLSGEINECTLR

SEQ ID NO: 1541 - DNA, 1317 bp, Pyrococcus furiosus
  CDS (1)..(1317)
atgagagtcgaagagtttcttaaacaaaagggaattgaagtgggcgactatgtcaggattattaaagttgaagacggagaaaaagtagaatatgaaggaatagtaatgcccccttacgagctctcagagggagatacggttgtaataaagcttgacaatgggtataacattggtattgcaattgaaaagatacaagaaataaatgtgatagaaaaagctaaggctaagcccgaagtgcacttcaaagcagaacttgagcctaggaaagagttacccacaataactatcctgggaactggagggactatagctagtagaatagattacgagactggagctgtttatccagcatttacagctgaggaacttgcaaaagctgttcccgaaatttttgagatagcaaacataaaacctaagctactcttcaacatatttagtgaggacatgaagcctaaacattggattgagattgctcatgaaacggcaaaggctctgaattctggaaacgaaggagttgtgatagcccacggaacagatacaatgggatacactgcagcagcactgagcttcatgttgagaaacttaacaaagcccgttgtcttagttggagcacagagaagtagcgatagacctagtagtgatgctgctatgaatcttatttgtgccacaagaatggcagtaagcgatgctgctgaggttatggtagttatgcacggagagacaagcgatacttactgcttagctcatagaggaacaaaggttaggaagatgcatacttcaaggagagatgcttttaggagtataaacgacattcccatagccaagatatggagtgatggaaaaatagaattccttagagacgattacaggaagagaagcgagggagaagtttgggttgatgataagctggaagaaaaagttgccctagtgaaggtttatcctgggatgtcagcagagttaatcgacttcttagtggataaggggtataaaggaatagtaattgaggggactggactagggcataccccctcagatctcattccaagtataaagagggcggttgatgagggtgtggcagtttgcatgacgagccagtgcctttatgggagggtgaacttaaacgtctatgcaactggaagaaagttgcttaaggcaggggttataccgtgtgaagacatgcttccagaaactgcctacgtaaagctaatgtgggttctcggtcatacaaatgacttaagggaagctaagaaaatgatgctcacaaactatgctggggaaataaccccctatactaaaccaaacactttccttatttga

SEQ ID NO: 1542 - protein, 438 aa, Pyrococcus furiosus
MRVEEFLKQKGIEVGDYVRIIKVEDGEKVEYEGIVMPPYELSEGDTVVIKLDNGYNIGIAIEKIQEINVIEKAKAKPEVHFKAELEPRKELPTITILGTGGTIASRIDYETGAVYPAFTAEELAKAVPEIFEIANIKPKLLFNIFSEDMKPKHWIEIAHETAKALNSGNEGVVIAHGTDTMGYTAAALSFMLRNLTKPVVLVGAQRSSDRPSSDAAMNLICATRMAVSDAAEVMVVMHGETSDTYCLAHRGTKVRKMHTSRRDAFRSINDIPIAKIWSDGKIEFLRDDYRKRSEGEVWVDDKLEEKVALVKVYPGMSAELIDFLVDKGYKGIVIEGTGLGHTPSDLIPSIKRAVDEGVAVCMTSQCLYGRVNLNVYATGRKLLKAGVIPCEDMLPETAYVKLMWVLGHTNDLREAKKMMLTNYAGEITPYTKPNTFLI

SEQ ID NO: 1543 - DNA, 1167 bp, Ashbya gossypii (Yeast) (Eremothecium gossypii)
  CDS (1)..(1167)
atgccgaacgccgacctagaaattaaaaccatcaatcccgacctagaagcatcgcagttcattatacaacctccggcagtacagtccggcgatggtgaaaacgtagccacggacgagagccaaaggggcgatgtatcatcgtcggtaagttcgcagaaatctacttcgctgccaagaattaagataattggtacaggcggcaccattgcgtcaaagggctcttcgtcctcgcagactgccggctaccatgtggacctgaccatccaagagctactcgaggccattccagacatctcaaatatctgcgagatagagtatgagcagctctgcaacgtggattccaaagacatcaacgaggagattcttctaaaattgtactcctgtatttccgaatctctgcagcgtttcaacggtattgtgattactcatgggacggatacgatggccgagaccgcctttttcattgaaagtacgatcgactctggtagtgttccgattgtatttgttggctctatgcgtccgtcaaccagtgtttctgcagacgggccaatgaacctttatcaggcgatctgcattgcatctaacgccaagtccaggcagcgcggagtgctcgtctcgctaaacgatcaaatatcatctggatactatatcatcaagaccaatgccaatactctggactcgttcaacgtgcggcagggatatctgggaaactttgtgaataacgaaatcctctactactatccacctgccaagccgctaggctgccacaagttcaagctcccgctgcagcccggccaaacgtcgctgaacttaccaaaagtagtcatcatttactctcaccaatccatctccccaatactggttgagcttgcgggaaagcgttgcaaaggtgtcgtgatagccaccatgggcgcggggacgctgccggaggcagttaacagcgcctgcatgcaactcacaatccccgtcgtgtactccaagcgctccatggaaggaatggtccccgtggcaaacctgcccctcccaccctccgatccccgctccaagattatagcctcgggctacctaaatccggaaaagagcaggatcctgctacaactgtgcttgaaccaagactacagtatcgatttgattaggcaggtatttcgcggcgtctacggcggctga

SEQ ID NO: 1544 - protein, 388 aa, Ashbya gossypii (Yeast) (Eremothecium gossypii)
MPNADLEIKTINPDLEASQFIIQPPAVQSGDGENVATDESQRGDVSSSVSSQKSTSLPRIKIIGTGGTIASKGSSSSQTAGYHVDLTIQELLEAIPDISNICEIEYEQLCNVDSKDINEEILLKLYSCISESLQRFNGIVITHGTDTMAETAFFIESTIDSGSVPIVFVGSMRPSTSVSADGPMNLYQAICIASNAKSRQRGVLVSLNDQISSGYYIIKTNANTLDSFNVRQGYLGNFVNNEILYYYPPAKPLGCHKFKLPLQPGQTSLNLPKVVIIYSHQSISPILVELAGKRCKGVVIATMGAGTLPEAVNSACMQLTIPVVYSKRSMEGMVPVANLPLPPSDPRSKIIASGYLNPEKSRILLQLCLNQDYSIDLIRQVFRGVYGG

SEQ ID NO: 1545 - DNA, 1041 bp, Pectobacterium atrosepticum
  CDS (1)..(1041)
atgtttaacgcattattcgttgttgtttttgtttgtttttcgtctctggcaaatgcggcagaaaatctacctaacattgtcattctggcaacaggcggtacgattgccggttcggcagcagccaatacgcaaaccactgggtataaagcgggtgcgctgggcgtagagacgctgattcaagcggtgcctgagctgaaaacgcttgccaatatcaaaggtgagcaggttgccagcatcggcagtgaaaatatgaccagcgatgtgttgttaacgctgagcaagcgcgtgaacgagctgctggcacgcagcgatgttgatggcgtggtcattacgcacggtacggatacgctcgacgaatctccttattttctgaacctgacggtgaaaagcgacaagccagtagtctttgttgctgcgatgcgtccggcaacggcaatcagtgccgacggcccgatgaacctgtacggtgcagtaaaagtggcagcggataaaaactcccgcggtcgcggtgtactggtcgtgctgaacgaccgcattggttctgcccgtttcatcagcaaaaccaacgcctctacgttggatacctttaaagcgccagaagaaggttatctgggcgtgattatcggtgacaaaatatactaccagacccgtctggataaagttcacaccacgcgttccgtgtttgatgtgaccaacgttgataagctgccagccgtcgacattatttatggttatcaggacgatccagaatatatgtatgacgcctctatcaaacacggcgtaaaaggcatcgtgtatgcgggcatgggtgcaggcagcgtatccaagcgcggcgacgctggcatccgtaaagcggaaagcaaaggcattgttgtcgtacgttccagccgtaccggcagcggtatcgtcccaccggatgcaggccaacccggtctggttgccgattctctgagtccagcaaaatcacgtattttactgatgctggcgctgacgaaaacgacgaacccagctgtgattcaggattacttccacgcttattaa

SEQ ID NO: 1546 - protein, 346 aa, Pectobacterium atrosepticum
MFNALFVVVFVCFSSLANAAENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 1547 - DNA, 1047 bp, Erwinia chrysanthemi
  CDS (1)..(1047)
atggaacgatggtttaaatctctgtttattattgctttcttctttatttctacggccaatgcggcagataagctgccaaacatcgtcattctggcgaccggcggtactattgccggctcggcggcgacgggtacccagactaccggttacaaggccggcgcgcttggcgtggatacgctgatcaacgccgtgcccgaggtgaaaaaactggctaacgtaaaaggcgagcaattcgccaacatggccagcgaaaacatgaccggcgatgtggtgctgaaactgagccagcgcgtgaatgcgctgctggcgcgtgacgatgtggacggcgtggtgattacccacggtacggacacgctggaggagtcggcctatttcctccacctgacggtgaaaagcgacaagccggtagtgtttgcggcggcgatgcgcccggccacggccattagcgccgacggcccgatgaacctgctggaagcggttcgcgtggcgagcgacaaacagtctcgcggccgcggcgtgctggtagtgctcaacgaccgtatcggttccgcccgttatatcaccaagagcaatgcctcgacgctggacagtttccgggcgaatgaagaaggttatctgggcgtggtgatcggtaaccatatctattaccagaatcgcctcgacaaactgcataccaaccgttcggtattcgatgtgcgcggcctggcctcgctgccgaaagtcgatattctttatgggtatcaagatgactcggaatacctgtacgacgccgccatcagccacggcgtgaaaggcatcgtttatgccggtatgggcgcgggttcggtatcggtgcgcggcatagccggaatgcgcaaggcgcaggataaaggcgtggtggtgatgcgctcttcccgcaccggcaacggcatcgtgccgccggatgaagcgctgccgggcctggtcgcggattcgctcaacccggcgcatgcccgaatcctgttgatgctggcattgacccgcaccagcgatccggcggtgatccaggactatttccacacctattga

SEQ ID NO: 1548 - protein, 348 aa, Erwinia chrysanthemi
MERWFKSLFIIAFFFISTANAADKLPNIVILATGGTIAGSAATGTQTTGYKAGALGVDTLINAVPEVKKLANVKGEQFANMASENMTGDVVLKLSQRVNALLARDDVDGVVITHGTDTLEESAYFLHLTVKSDKPVVFAAAMRPATAISADGPMNLLEAVRVASDKQSRGRGVLVVLNDRIGSARYITKSNASTLDSFRANEEGYLGVVIGNHIYYQNRLDKLHTNRSVFDVRGLASLPKVDILYGYQDDSEYLYDAAISHGVKGIVYAGMGAGSVSVRGIAGMRKAQDKGVVVMRSSRTGNGIVPPDEALPGLVADSLNPAHARILLMLALTRTSDPAVIQDYFHTY

SEQ ID NO: 1549 - DNA, 1257 bp, Methanococcus maripaludis
  CDS (1)..(1257)
atggatatcggtgattttgtaaaactcgaactggaaaacacgacgtattctggaacggtaatgccttctttaaacgaggatactgttgtaattaaaatgaaaagcggatacaacgttggaatcgataagaaaaaaataaaaaatattgaaatattggaatccggagacaaaccaaaatacggccttccacctcttaatttggaaaaaaacccaaaattaaaaaacatctctattttatcaactggtggaacagttgcttcaagagtggactataaaactggagcagttcacccggcatttacagcagatgatttaattagggcagttcctgaattaatggacgttgcaaacatcaaaggaaaagttattttgaatattttaagtgaaaacatgcttccaaagtactgggtgatgactgctgacgcaataaaagaggaaattgaaaacggagctgagggtattgttattgcacacggaaccgacactatgcactacaccgcatcagcactttcattcatggtaaattctgaagttccaattattttggttggtgctcaaagaagtagtgatagaccttcttcagatgcagcattaaacataattgcagcggtaaaagcagcaactgaaccaataaaaggagtttatgtacttatgcacggtgaaactggggataccgtatgccatttacacgaaggaacaaaagttagaaaactccactcatcaagaagagatgcattcaaatcagtaaatgaaactccaatagctgaagttaacccatttacaaaaaaagtaacatatttaagagaagttaaaagtcaggacaggtcaaaaatcaaagaagtagtgttaaacacaaatttggaagaaaaagttgctttaattaaagtttatcctggaattgattctgaaattttgaaattctacgttgataatggatacaaaggaattattttagaaggaactggacttggacacacccctgaaaccttttttgaaggaatcgattacgcaaatgaaaacaatgttttagttgcaatgactactcagacgatcaatggtcgagtaaacatgaatgtttattcaaatgggcgagaacttcaggcaaaaggcgtaattccttgtgaagacatgctttcagaagttgcatttgttaaattaatgcatttgcttggaaattatgaatttaaggaagcaaaagaattaatgtctaaaaacattgctggagaaattaacgaatctattaatctggagtgttaa

SEQ ID NO: 1550 - protein, 418 aa, Methanococcus maripaludis
MDIGDFVKLELENTTYSGTVMPSLNEDTVVIKMKSGYNVGIDKKKIKNIEILESGDKPKYGLPPLNLEKNPKLKNISILSTGGTVASRVDYKTGAVHPAFTADDLIRAVPELMDVANIKGKVILNILSENMLPKYWVMTADAIKEEIENGAEGIVIAHGTDTMHYTASALSFMVNSEVPIILVGAQRSSDRPSSDAALNIIAAVKAATEPIKGVYVLMHGETGDTVCHLHEGTKVRKLHSSRRDAFKSVNETPIAEVNPFTKKVTYLREVKSQDRSKIKEVVLNTNLEEKVALIKVYPGIDSEILKFYVDNGYKGIILEGTGLGHTPETFFEGIDYANENNVLVAMTTQTINGRVNMNVYSNGRELQAKGVIPCEDMLSEVAFVKLMHLLGNYEFKEAKELMSKNIAGEINESINLEC

SEQ ID NO: 1551 - DNA, 25 bp, Primer
atggagtttttcaaaaagacggcac

SEQ ID NO: 1552 - DNA, 25 bp, Primer
ttagtactgattgaagatctgctgg

SEQ ID NO: 1553 - DNA, 327 bp, Escherichia coli, and
  CDS (1)..(327)
atgagccagtggaaagacatctgcaaaatcgatgacatcctgcctgaaaccggcgtctgcgcgctgttaggtgacgagcaggtcgcgattttccgcccgtatcacagcgatcaggtgtttgcgatcagcaacatcgacccgttcttcgagtccagcgtgctgtcacgcggactgattgcggaacaccagggcgagctgtgggtcgccagcccgctgaaaaaacagcgttttcgcttaagcgacggcttgtgcatggaagacgaacagttttccgtcaaacattacgaagcgcgagtgaaagacggcgtggtgcagctgcgcggttaa

SEQ ID NO: 1554 - protein, 108 aa, Escherichia coli, and
MSQWKDICKIDDILPETGVCALLGDEQVAIFRPYHSDQVFAISNIDPFFESSVLSRGLIAEHQGELWVASPLKKQRFRLSDGLCMEDEQFSVKHYEARVKDGVVQLRG

SEQ ID NO: 1555 - DNA, 357 bp, Mycobacterium tuberculosis
  CDS (1)..(357)
atgacgcttctcaacgacattcaggtatggaccaccgcctgcgcatacgaccatctcattccgggacgtggtgtcggggtgttactcgatgacggtagtcaggtggcactgttccggctcgacgacggctcggtgcacgcggtcggtaacgtcgacccgttctccggtgctgcggtgatgtcccgcggcatcgtcggtgatcgcggaggtcgcgccatggtgcaatcgccgatcctgaagcaggctttcgcgctcgacgatggctcgtgcctcgacgatccgcgcgtttcggtgccggtgtatccggcgcgcgtcacacccgaaggccgcattcaggtcgcgcgggtagcggtctag

SEQ ID NO: 1556 - protein, 118 aa, Mycobacterium tuberculosis
MTLLNDIQVWTTACAYDHLIPGRGVGVLLDDGSQVALFRLDDGSVHAVGNVDPFSGAAVMSRGIVGDRGGRAMVQSPILKQAFALDDGSCLDDPRVSVPVYPARVTPEGRIQVARVAV

SEQ ID NO: 1557 - DNA, 327 bp, Yersinia pestis
  CDS (1)..(327)
atgagccagtggatcccactatgcccgttaaatgacatcttacccggcagcggtgtttgtggcctgattaagcaacagcaggtcgcggtcttccgcccttatgctgacgaacaggtttttgccattagcaatatcgatccttttgcacaagccagtgtgctatcgcggggattaattgcagaacatcaaggtgagttatgggtcgccagcccactgaaaaagcagcacttccgtctgcgtgatggcttttgtttggaagatgaagatcgctccgtgacccattatgacgtgcgagtgcgcgacggtatggtgcaagtcaacgcgtaa

SEQ ID NO: 1558 - protein, 108 aa, Yersinia pestis
MSQWIPLCPLNDILPGSGVCGLIKQQQVAVFRPYADEQVFAISNIDPFAQASVLSRGLIAEHQGELWVASPLKKQHFRLRDGFCLEDEDRSVTHYDVRVRDGMVQVNA

SEQ ID NO: 1559 - DNA, 327 bp, Salmonella enterica subsp. enterica serovar Typhi
  CDS (1)..(327)
atgagtcagtggcaaaacatctgcaaaatcgatgacatcctgccgggaaccggcgtctgcgcgctgtcaggcggcgagcaggtggcaattttccgtccttaccatagcgatcaggtgtttgcgatcagcaacatcgacccgttctttgaggccagtgtgctgtctcgtgggctgattgcggaacaccagggcgaactgtgggtcgccagcccgttgaaaaagcagcgcttccgcctgagcgatggtttatgcatggaagatgagcagttttctgtgaaacattacgacgcgcgggtaaaagacggcgtggtgcagttgcgcggttaa

SEQ ID NO: 1560 - protein, 108 aa, Salmonella enterica subsp. enterica serovar Typhi
MSQWQNICKIDDILPGTGVCALSGGEQVAIFRPYHSDQVFAISNIDPFFEASVLSRGLIAEHQGELWVASPLKKQRFRLSDGLCMEDEQFSVKHYDARVKDGVVQLRG

SEQ ID NO: 1561 - DNA, 324 bp, Vibrio vulnificus (strain YJ016)
  CDS (1)..(324)
atgcaaagtaaacaatttatctgccatctcaatgaactgaaaagtgaccatggccatcctgtgctattgaatgatgagcaactggcgatgttctatgtgcctaaggagggggtgtttgcgatacaaaactgggacccgattggcaaagcttttgtattaagccgcggcattgtcggggatatccaaggtgagctctgcgttgcctctccgttgtataaacagcatttttgcttaaaaacaggtaagtgctttgaagatgatgcggtcaagctaatgacatggccagtgctggtggaaaacgacgccgtttacgttctaggctag

SEQ ID NO: 1562 - protein, 107 aa, Vibrio vulnificus (strain YJ016)
MQSKQFICHLNELKSDHGHPVLLNDEQLAMFYVPKEGVFAIQNWDPIGKAFVLSRGIVGDIQGELCVASPLYKQHFCLKTGKCFEDDAVKLMTWPVLVENDAVYVLG

SEQ ID NO: 1563 - DNA, 351 bp, Streptomyces avermitilis
  CDS (1)..(351)
atgaccctggcacccgagacgaccgccctgaaggttcacctcagcctggggggagactggttgtccatctgcgacctgtccctgctgacgccgggacgcggggtggccgcgctgctgcccgacggctgccaggtggccctcttcctcgaccgcgcgggccgtgtgtacggcatcgacaaccgcgacccgttcagcggcgcggccgtcctgtcccgcggcctcaccggcacccaccagggccgcccgttcgtcgcctccccgctcctcaagcagcggttcgacctggagtcggggcagtgcctggacgacgagtcggtccgcatcgccacgtacgaggtgcgtacctcgtag

SEQ ID NO: 1564 - protein, 116 aa, Streptomyces avermitilis
MTLAPETTALKVHLSLGGDWLSICDLSLLTPGRGVAALLPDGCQVALFLDRAGRVYGIDNRDPFSGAAVLSRGLTGTHQGRPFVASPLLKQRFDLESGQCLDDESVRIATYEVRTS

SEQ ID NO: 1565 - DNA, 336 bp, Vibrio parahaemolyticus
  CDS (1)..(336)
atggcagctttaaccaaagtgaaattgtgtcagcttgatgacttaatgccgtttatcggtgccacggtgttgattgaaggcgagcgtgtcgcgttattctacattcctgatagcggtgtttacgccgttcaagattgggacccaataggtaaggcttatgtgatgagtcgagggattgtcggtgatatcaatggtgagatgtgtgttgcgtcaccactgtacaaacagcatttcagcttaaagagcgggcagtgtttggaagacgaggcgcactgtctaaaaacgtggcgagtaacggtcgacgataatcaggtctgctacttagctaaggaatga

SEQ ID NO: 1566 - protein, 111 aa, Vibrio parahaemolyticus
MAALTKVKLCQLDDLMPFIGATVLIEGERVALFYIPDSGVYAVQDWDPIGKAYVMSRGIVGDINGEMCVASPLYKQHFSLKSGQCLEDEAHCLKTWRVTVDDNQVCYLAKE

SEQ ID NO: 1567 - DNA, 330 bp, Vibrio parahaemolyticus
  CDS (1)..(330)
atgaacatgtcatttgaaaagatttgccaaatcagcgacatcgtaccgggcactggcgtttgtgctttggttaatggtcagcaagttgcggtatttcgcccaacagaagcggaagaagtgttagctatcagcaacaccgacccgttcttccaatcgaacgtgctttctcgcggtttgatttgtgaacatcaaggagagctttgggtggcgagcccgcttaaaaagcaacgctttaacctgacaacaggtgcttgtatggaagacgagcgttttaacgtgaaagcgtacaaagcgcgcgtgacaaacggcgaagtcgagattcaagcgtaa

SEQ ID NO: 1568 - protein, 109 aa, Vibrio parahaemolyticus
MNMSFEKICQISDIVPGTGVCALVNGQQVAVFRPTEAEEVLAISNTDPFFQSNVLSRGLICEHQGELWVASPLKKQRFNLTTGACMEDERFNVKAYKARVTNGEVEIQA

SEQ ID NO: 1569 - DNA, 387 bp, Pseudomonas syringae (pv. tomato)
  CDS (1)..(387)
atgaattcgcctgaaacaacgtggactgaagaaaacagctcttgcgcgctgcatctgcactggtatgccctgtgtgagcgcaaggacctggtcgccaattccggcgtggtggcctggctggacgggaaacagttagcgctgttctatctacctgacacagcgcaaggagagcaattgtttgccatcgacaaccgcgacccgaaatccggtgcgaatgtgatcggacgtgggctgactggccagattgcgggtgagctggttattgcctcgccgctgtacaagcagcattttcgcctgcacgacggcagttgcatcgagtacccggaacagcgcctggaagtctggccggtgcgcctgaacggcgaacgggtggaaattgcggtctag

SEQ ID NO: 1570 - protein, 128 aa, Pseudomonas syringae (pv. tomato)
MNSPETTWTEENSSCALHLHWYALCERKDLVANSGVVAWLDGKQLALFYLPDTAQGEQLFAIDNRDPKSGANVIGRGLTGQIAGELVIASPLYKQHFRLHDGSCIEYPEQRLEVWPVRLNGERVEIAV

SEQ ID NO: 1571 - DNA, 363 bp, Pseudomonas putida (strain KT2440)
  CDS (1)..(363)
atgaacctggccaatgctgctgtgaacacgcaagaaaactggcagacggtgtgccaggcacaagacctggtggccgactccggcgtcgtggtttggctcgatggggcccaggtggcgttgttctacctgccggggcaggcccagccgctgtacgcggtggacaaccgcgacccacgctccggtgccaatatcatcggtcgtgggctggtgggcagtgtgcaaggtgagttggtggtggcagcgccgctctacaagcagcacttcagcctgctgagtggggagtgtctggaggatgccgggcagaggttgcgggtgtggccggtgcggttgaagggggaggcggtggagctggcggtggcctga

SEQ ID NO: 1572 - protein, 120 aa, Pseudomonas putida (strain KT2440)
MNLANAAVNTQENWQTVCQAQDLVADSGVVVWLDGAQVALFYLPGQAQPLYAVDNRDPRSGANIIGRGLVGSVQGELVVAAPLYKQHFSLLSGECLEDAGQRLRVWPVRLKGEAVELAVA

SEQ ID NO: 1573 - DNA, 324 bp, Vibrio vulnificus
  CDS (1)..(324)
atgcaaactaaacaatttatctgccatctcaatgaactgaaaagtgaccatggccatcctgtgttattggatgatgagcaattggcgatgttttatgtgcctaaggagggggtgtttgcgatacaaaactgggacccgattggcaaagcttttgtattaagtcgcggcattgtcggggatatccaaggtgagctctgcgttgcctctccgttgtataaacagcatttttgcttaaaaacaggtaagtgctttgaagatgaatcggtcaaattaacgacatggccagtgctggtggaaaacgacgccgtttacgttctaggctag

SEQ ID NO: 1574 - protein, 107 aa, Vibrio vulnificus
MQTKQFICHLNELKSDHGHPVLLDDEQLAMFYVPKEGVFAIQNWDPIGKAFVLSRGIVGDIQGELCVASPLYKQHFCLKTGKCFEDESVKLTTWPVLVENDAVYVLG

SEQ ID NO: 1575 - DNA, 324 bp, Vibrio vulnificus
  CDS (1)..(324)
atggcttttgaacaagtatgcgacattaacgacattattccaggtacgggtgtttgtgccttggtcaatgggcagcaaattgcgctgtttagaccaagtgaagaagagcaggtatttgctatcagtaacatggacccatttgcgcgctcaaacgtgttatctcgcggtttgatcgccgagcacaaaggcgagctttgggttgcgagtccactgaaaaagcagcgctttaacttggcaacgggtgcgtgtatggaagatgaacgttttaacatcaaagcataccaagcgcgcgtcaataacggcattgtcgaaatctctgcttaa

SEQ ID NO: 1576 - protein, 107 aa, Vibrio vulnificus
MAFEQVCDINDIIPGTGVCALVNGQQIALFRPSEEEQVFAISNMDPFARSNVLSRGLIAEHKGELWVASPLKKQRFNLATGACMEDERFNIKAYQARVNNGIVEISA

SEQ ID NO: 1577 - DNA, 342 bp, Ralstonia solanacearum (Pseudomonas solanacearum)
  CDS (1)..(342)
atgcaagccaatcattggaccgccatctgcgcgctggacgacatcgtgcccaacaccggcgtctgcgcgctggtcgggggggcgcaaatcgccgtgttccacgtggccggcgatgcgccgcgccgcgtctacgccatcggcaactacgacccgaacgcggacgccgccgtgctctcgcgcggcctggtcggcaacctgggcgagcgcatcgtggtggcttcgcccatctacaagcagcacttcgacctggccaccggcgagtgcctggaagccccggccaactcggtgccggcctacgccgccaaggtggaagacggcaaggtctggatcgcacagcaatga

SEQ ID NO: 1578 - protein, 113 aa, Ralstonia solanacearum (Pseudomonas solanacearum)
MQANHWTAICALDDIVPNTGVCALVGGAQIAVFHVAGDAPRRVYAIGNYDPNADAAVLSRGLVGNLGERIVVASPIYKQHFDLATGECLEAPANSVPAYAAKVEDGKVWIAQQ

SEQ ID NO: 1579 - DNA, 342 bp, Amycolatopsis mediterranei (Nocardia mediterranei)
  CDS (1)..(342)
atgaccacgtcgatcgaacgaacctggacggcggtgtgcgcggcggaggtcgtgccggagtactcgggggtcgccgcgctgctggacggcgtccaggtggcgatcttccggctgcccggcgaccggtggtacgcactgtccaactgggacccgtgcagcggcgcggcggtgctctcgcgcggcatcgtcggcgacgcggacggcgtgccggtggtcgcttcgccggtctacaaggagcggttcgccctcgacagcgggcagtgcctggacgctgcggacgtttcggtgccggtgtacgaggtgcgggtgcgggaaggcgtcgtcgaagtggagagcccgtga

SEQ ID NO: 1580 - protein, 113 aa, Amycolatopsis mediterranei (Nocardia mediterranei)
MTTSIERTWTAVCAAEVVPEYSGVAALLDGVQVAIFRLPGDRWYALSNWDPCSGAAVLSRGIVGDADGVPVVASPVYKERFALDSGQCLDAADVSVPVYEVRVREGVVEVESP

SEQ ID NO: 1581 - DNA, 327 bp, Klebsiella aerogenes
  CDS (1)..(327)
atgagccagtgggtaaatatctgcagcatcgacgacatcctgccggccaccggcgtctgcgccctgctcggtcagcagcaggtggcgatcttccgtccctaccatgacgacagagtattcgccatcagcaacattgatccgttcttcaacgccagcgtactgtctcgcgggattatcgccgagcatgacggcgcgctatgggtcgccagcccgctgaaaaaacagcgcttccgcctgagcgacggcctgtgcatggaagatgccagccactctatcgcccgcttcgacgcccgcgtgaaagacggacacgttcagcttaaagcgtaa

SEQ ID NO: 1582 - protein, 108 aa, Klebsiella aerogenes
MSQWVNICSIDDILPATGVCALLGQQQVAIFRPYHDDRVFAISNIDPFFNASVLSRGIIAEHDGALWVASPLKKQRFRLSDGLCMEDASHSIARFDARVKDGHVQLKA

SEQ ID NO: 1583 - DNA, 396 bp, Streptomyces coelicolor
  CDS (1)..(396)
atggcacccgagaccctcgcccccgacacgaccggcctggaggtccggctgcggctgacggacgactggttcacggcctgcgacctcggcgccctgctcccgggccggggcgtggcggccctgctgccggacggcggccaggtggccctgttccgcgaccgggacggcgggctgtacgccatcgacaaccgggacccgttcaccggcgcggcggtcctctcccgcggcctgaccggcacccaccagggccgcccgttcgtcgcctccccgctgctcaagcagcgcttcgacctcacgaccggggagtgcctggacgacgcggcgatgcgggtggagacgtatcgggtacaggccgtgcgggcggtgccggccgtgaacgccgtgaaccccgcctga

SEQ ID NO: 1584 - protein, 131 aa, Streptomyces coelicolor
MAPETLAPDTTGLEVRLRLTDDWFTACDLGALLPGRGVAALLPDGGQVALFRDRDGGLYAIDNRDPFTGAAVLSRGLTGTHQGRPFVASPLLKQRFDLTTGECLDDAAMRVETYRVQAVRAVPAVNAVNPA

SEQ ID NO: 1585 - DNA, 339 bp, uncultured bacterium
  CDS (1)..(339)
atgaccaccgacaccctgaactggaccgccgtgtgcgcggtcgatgacatccttcccaacaccggcgtgtgcgcgctgatcgatgaccgccacgtcgccattttccgcgtcgggcaaagcgaatttttcgccatcgacaacgtcgaccccaagtcgaacgccagcatcaacgcccggggcctgctgggcaacctgggcgaccgcaccgtcgtcgcgtccccgatgtacaagcaccacttcgacctgcgcagtggtgaatgcatcgaaacccccgagtactcggtgcgtgcccacgaggtgcgcattgaagacggcagggtgctggtcgccgtcgaatga

SEQ ID NO: 1586 - protein, 112 aa, uncultured bacterium
MTTDTLNWTAVCAVDDILPNTGVCALIDDRHVAIFRVGQSEFFAIDNVDPKSNASINARGLLGNLGDRTVVASPMYKHHFDLRSGECIETPEYSVRAHEVRIEDGRVLVAVE

SEQ ID NO: 1587 - DNA, 300 bp, Mycobacterium paratuberculosis
  CDS (1)..(300)
atgtcggggtgctgctcgacgacggtttcccaggcggcgctgttccggctcgacgacggcacggtgcgcgcggtgggcaacgtcgacccgttctccggggcggccgtgctgtcccgcggcatcgtgggcgaccgcaacggctgcccgacggtgcagtcgcccatcctcaagcaggcgttctccctcgaagacggtatctgcctggacgatccgagcgtttcggtgccggtgtacccggtgcgcatcaccgccgacagctacgttcaggtgggccgcgactaccagccgcgggcggcctga

SEQ ID NO: 1588 - protein, 99 aa, Mycobacterium paratuberculosis
MSGCCSTTVSQAALFRLDDGTVRAVGNVDPFSGAAVLSRGIVGDRNGCPTVQSPILKQAFSLEDGICLDDPSVSVPVYPVRITADSYVQVGRDYQPRAA

SEQ ID NO: 1589 - DNA, 22 bp, Primer
atgagccagtggaaagacatct

SEQ ID NO: 1590 - DNA, 21 bp, Primer
ttaaccgcgcagctgcaccac

SEQ ID NO: 1591 - DNA, 966 bp, Escherichia coli
  CDS (1)..(966)
atgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtga

SEQ ID NO: 1592 - protein, 321 aa, Escherichia coli
MGKAVIAIHGGAGAISRAQMSLQQELRYIEALSAIVETGQKMLEAGESALDVVTEAVRLLEECPLFNAGIGAVFTRDETHELDACVMDGNTLKAGAVAGVSHLRNPVLAARLVMEQSPHVMMIGEGAENFAFARGMERVSPEIFSTSLRYEQLLAARKEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1593 - DNA, 918 bp, Pyrococcus horikoshii
  CDS (1)..(918)
atggtagctatcatcgttcatgggggtgctggaacaataaaaaaagaagaaaggataccaaaggttattgagggagtaaaagaagccgttattgttgggtggaaagaacttaggaagggatctgctttagatgctgtggaggaagccattaaagttcttgaggataaccctatattcaatgccggaactgggagcgttctcacgatcgatggaaaagttgaaatggatgctgcaataatgagagggaagacgctagaagctggagctgtggccgggatatggggagttaagaatccgataagtgttgcaagaaaggtaatggaaaagactgatcatgtactccttgttggggaaggtgcagtaaagtttgctagactcatgggattccctgaatacaatccaataacggaagaaaggattgagcagtggaaagaactaaaggaaaagctaatgaaaggtgagatcaagtactggaaaaagcttggtgagcttataaaagagtatccagaagttttgaggagtaccgttggggccgtagcttttgacggggaagaaatagttgcaggaacttcaactgggggagtttttttgaagatgtttggaagggttggtgatactcccataataggggctggaacttatgcaaatgaagttgctggagcgtcttgtactggactaggagaggttgcaataagacttgcattggcgaaaaccgcaaccgacttcgtcagacttggtatggatgctcaagcagccagcaatgcggcaatctctcttgcaacaaagtactttgggaaggatactatggggataataatggtagatgcagccggtaacgttgggttcgctaagaatacgaagcatatgagctatgcttatatgaaagatggtatggaggaaccggaggctggtgtttag

SEQ ID NO: 1594 - protein, 305 aa, Pyrococcus horikoshii
MVAIIVHGGAGTIKKEERIPKVIEGVKEAVIVGWKELRKGSALDAVEEAIKVLEDNPIFNAGTGSVLTIDGKVEMDAAIMRGKTLEAGAVAGIWGVKNPISVARKVMEKTDHVLLVGEGAVKFARLMGFPEYNPITEERIEQWKELKEKLMKGEIKYWKKLGELIKEYPEVLRSTVGAVAFDGEEIVAGTSTGGVFLKMFGRVGDTPIIGAGTYANEVAGASCTGLGEVAIRLALAKTATDFVRLGMDAQAASNAAISLATKYFGKDTMGIIMVDAAGNVGFAKNTKHMSYAYMKDGMEEPEAGV

SEQ ID NO: 1595 - DNA, 918 bp, Pyrococcus abyssi
  CDS (1)..(918)
atggtggctattatcgttcatggtggagctggaacaatacgtaaggaggagagaattccaaaggttcttgagggagttagagaggcagttttagctgggtggaaggagttaaagaaaggatcagctttggatgccgttgaagaggccataaaggttctcgaagataacccaattttcaacgcgggaaccggaagcgtcttgacgatagatggcaaggttgagatggatgctgcaataatgcgtggtaaaaccttggaagctggtgcagtcgctggaatctggggggttaagaatccaataagcgttgcgagaaaagtgatggagaagacggatcacgttcttctagttggagaaggtgcagtaaagttcgcgaggataatgggctttcccgaatacgatccaacaactgaagaaagaaggaagcagtggcaggagttgaaggagaagctaatgaaaggcgaagttagacattggaaaaagctcggtgaactcataaaggagcatccagaggttctaaggagcactgttggtgcggttgcctttgatggagaggaagtcgtcgctggaacttcaacgggaggagttttccttaagatgtttggaagggttggagatacccccataataggggccggaacttatgcaaacgaagttgctggcgcatcttgcactgggcttggggaggttgccataaagctagccctggctaaaactgccacagacttcgttaggcttggcttagatgctcaggcggccagtgaagctgccatagagcttgccacaaagcactttggcaaggatacaatggggataataatggttgattctaggggaaacgtaggcttcgcgaagaacaccaagcatatgagctatgcattcatgaaggagggcatgaacgagccggaggctggtgtttag

SEQ ID NO: 1596 - protein, 305 aa, Pyrococcus abyssi
MVAIIVHGGAGTIRKEERIPKVLEGVREAVLAGWKELKKGSALDAVEEAIKVLEDNPIFNAGTGSVLTIDGKVEMDAAIMRGKTLEAGAVAGIWGVKNPISVARKVMEKTDHVLLVGEGAVKFARIMGFPEYDPTTEERRKQWQELKEKLMKGEVRHWKKLGELIKEHPEVLRSTVGAVAFDGEEVVAGTSTGGVFLKMFGRVGDTPIIGAGTYANEVAGASCTGLGEVAIKLALAKTATDFVRLGLDAQAASEAAIELATKHFGKDTMGIIMVDSRGNVGFAKNTKHMSYAFMKEGMNEPEAGV

SEQ ID NO: 1597 - DNA, 942 bp, Salmonella enterica subsp. enterica serovar Typhi
  CDS (1)..(942)
atgaataaagcagtgattgcgattcacggcggcgcaggcgcgattgctcgcgcgcaaatgagccatgagcaggagctacgctatatccaggcgctgtcagagattgtcgaaagcgggcaaaagatgctggaagcgggtgacagcgcgcttgatgtagtgacggaagcggtgcgcctgctggaagcgtgtccgctcttcaatgcgggtatcggcgcggtctatacccgagacggaactcatgaactggatgcctgcgtgatggacggcaataccctgaaagccggagccgtcgcgggcgtgagtcatgttcgccatcctgtgctcgccgccagactggtgatggagcgcagcccgcatgtactcatggtgggggaaggggcggaaaactttgccttttcacaggggatggcgcgcgtttcgccggatatcttttccaccccggcgcgttacgagcaattgctggcggcgcgtgcggcgggcgaaatggcgctcgatcacagcggcgcgccgctggacgaaacgaaaaaaatgggtacagtcggcgcggtggcgcgggataaattcggcaatctggcggcggcaacgtctaccggcgggatgaccaataaattgcccgggcgcgtcggcgacagcccgctggtcggcgccgggtgttatgccaacaacgccagcgtcgccgtttcctgtaccggaacgggagaggtctttattcgcacgctcgcggcttacgatatcgccgcattgatggaatatggcggactcagccttgccgacgcctgtgagcgcgtggtgatggaaaaattaccggcgctgggcggcagcggtggattaatcgccgttgatcacgaaggtaatgtcgcgttgccgtttaacagcgaagggatgtatcgcgcctggggatatgccggggatacgcctaccacaggaatttaccgggaataa

SEQ ID NO: 1598 - protein, 313 aa, Salmonella enterica subsp. enterica serovar Typhi
MNKAVIAIHGGAGAIARAQMSHEQELRYIQALSEIVESGQKMLEAGDSALDVVTEAVRLLEACPLFNAGIGAVYTRDGTHELDACVMDGNTLKAGAVAGVSHVRHPVLAARLVMERSPHVLMVGEGAENFAFSQGMARVSPDIFSTPARYEQLLAARAAGEMALDHSGAPLDETKKMGTVGAVARDKFGNLAAATSTGGMTNKLPGRVGDSPLVGAGCYANNASVAVSCTGTGEVFIRTLAAYDIAALMEYGGLSLADACERVVMEKLPALGGSGGLIAVDHEGNVALPFNSEGMYRAWGYAGDTPTTGIYRE

SEQ ID NO: 1599 - DNA, 957 bp, Nostoc sp. PCC 7120
  CDS (1)..(957)
atgaagtcacaggtgcaaccaaaattaattattcatgggggagcaggtagttctctccacggcaaaggtggattagaagcagtgcgccaaacgcttcatgcagtagtagaggaagtctacgctctattattgtcaggagtgaatgcttctgtggcagtggtacgcggttgtcaactgttggaagatgaaccccgcttcaatgctggtactggttcggtgctgcaatctgatgggcaaatccgcatgagtgcttccatcatggatggtgcattaggacgctttagtggtgtaataaatgtttcacgggtaaaaaatccgattgagttagcacaatttttacaaaattctccagacagagtgctgtcagattatggttcggctgaattagccagggaaatgcaaatccctagttacaatgctttaactgagctgcgattacaagaatggatacaagaacggcaagataattttaaaagaacaatggctggggtaatagccgaaccagaactattggaaactagtaatgctgggcgcggtacaatcggtgtagtagctttagatacctatggtaaattagcagtaggtacttctacaggtggcaaaggctttgagcgcattgggcgcgtcagtgattctgctatgccagcaggtaattatgctactagttatgccgcagtcagttgtactggcatcggtgaagacattattgatgagtgcctagcccccaagattgtcattcgtgtcacagatggattgtccctccaagactctatgcagcgatcctttgccgaagcacacgacaacaaaagagatttcggagcgatcgccttagatgccaatggtgcgatcgcctggggtaaaacttgtgacatcatcctcgccgccttccatgatggcgaaaagattggcgatacattagaacttgcggttggtacgcaggtgggtagtatcagttag

SEQ ID NO: 1600 - protein, 318 aa, Nostoc sp. PCC 7120
MKSQVQPKLIIHGGAGSSLHGKGGLEAVRQTLHAVVEEVYALLLSGVNASVAVVRGCQLLEDEPRFNAGTGSVLQSDGQIRMSASIMDGALGRFSGVINVSRVKNPIELAQFLQNSPDRVLSDYGSAELAREMQIPSYNALTELRLQEWIQERQDNFKRTMAGVIAEPELLETSNAGRGTIGVVALDTYGKLAVGTSTGGKGFERIGRVSDSAMPAGNYATSYAAVSCTGIGEDIIDECLAPKIVIRVTDGLSLQDSMQRSFAEAHDNKRDFGAIALDANGAIAWGKTCDIILAAFHDGEKIGDTLELAVGTQVGSIS

SEQ ID NO: 1601 - DNA, 945 bp, Agrobacterium tumefaciens
  CDS (1)..(945)
atgacgaagatcgcactggccattcacggtggttgcggcgtgatgccggaagacagcatgacggcggcggaatgggccgcggcccgtgaagatctggcagcagcgctgcgggccggttatggcgtgctgaaggcgggcggaacagcgctcgaggccgttgaggcagcggtcgtcgtcatggaggacagcccgcacttcaatgcgggacacggggcggcgctgaacgaaaacggcattcacgaactcgatgcctcgatcatggacggggccacgctttcggcaggcgcgatcagcgcatcccgcgccattcgcaatcctgtgaaggcggcccgcgcactgatggtggatgaacgggcggtctatctcacaggagaggctgcggatcgctttgccacggagaagggtctcgccaccgaacctcagtcctatttcaccacgcaaaaacgcctcgaggcactggcagcgatgaagcgccatgcagccacaggcacggaagcgacggaaaacgaaaagcacggaaccgtcggcgcggtggcgctcgatgcggcggggcaccttgctgcggccacctcaaccggcggctataccaacaagccggatggccgggtgggcgacagccccgtgatcggcgccggcacctatgcgcgcgacggcgcctgcgcggtctccggcaccggcaagggtgagtttttcatccgttatgtcgtcggccacgagatcgcgtcacgcgtcgcctatctcggacaggatctggaaaccgccgccggcaatctcgtgcacagggacctggctccctatgatatcggtgccggtctggtcgccattgatgcgaagggcggcattaccgctccgtacaatacaccaggcatgttccgcggctgggttacggcgtctggagaggcgtttgtggccactcacgctgaagcttacgccgtcaaattataa

SEQ ID NO: 1602 - protein, 314 aa, Agrobacterium tumefaciens
MTKIALAIHGGCGVMPEDSMTAAEWAAAREDLAAALRAGYGVLKAGGTALEAVEAAVVVMEDSPHFNAGHGAALNENGIHELDASIMDGATLSAGAISASRAIRNPVKAARALMVDERAVYLTGEAADRFATEKGLATEPQSYFTTQKRLEALAAMKRHAATGTEATENEKHGTVGAVALDAAGHLAAATSTGGYTNKPDGRVGDSPVIGAGTYARDGACAVSGTGKGEFFIRYVVGHEIASRVAYLGQDLETAAGNLVHRDLAPYDIGAGLVAIDAKGGITAPYNTPGMFRGWVTASGEAFVATHAEAYAVKL

SEQ ID NO: 1603 - DNA, 609 bp, Escherichia coli
  CDS (1)..(609)
atgatgatgattggcgaaggggcagaaaattttgcgtttgctcatggcatggagcgcgtctcaccggagattttctccacgcctttgcgttatgaacaactaatggcagcgcgcgaggaaggggcaacagtcctcgaccatagcggtgcgccactggatgaaaaacagaaaatgggcaccgtgggggccgtggcgttggatttagacggcaatctggcggcagccacgtccacgggcggaatgaccaataaattacccggacgagttggcgatagccccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtga

SEQ ID NO: 1604 - protein, 202 aa, Escherichia coli
MMMIGEGAENFAFAHGMERVSPEIFSTPLRYEQLMAAREEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1605 - DNA, 885 bp, Halobacterium sp. NRC-1
  CDS (1)..(885)
atgcgcgtgctcgttcacggtggtgccggggctccccccgacgcgcccgcaccccgccaagacaccctggagacggcagccgacaccggcgcatcgcacgcaacgcccgtcgacgcagtcacggcggccgttcgcgtcctggagcgcgaccccgcgttcaacgcgggcaccggcgcgacaccccaatcggatggcgtgatccgcaccgacgcgggcatgatgaccagcgaccgcgcggccggcgcagccgcctcgatgcccggcgtcgaggccgcggtcgccgtcgcccgcgcggtcatggcggacaccccgcacgtgctgttgagcggcgtgcacgccgtcgacttcgccgccgacaccggcatccctgtcgagtcggatctctggaccgccgacacccgtgcccgctgggacgacctcgactcccatcccgacgggtcacccaccgaccaccgcgactgggtgcgggagcggttcggacgcactgaccccggcggccgcgagtcgccgcccggcgaccacgacaccgtgggcgcggtggcgtccgacggcgaccggttcgcaaccgcgacctcgacgggcggccggtggctcgcgctcgccgggcgcgtcggcgacgtgccccagatcggggccgggttctacgccgccccggcgggcgcggcgtcggccaccggcgctggcgaggccatcgcgaaaaccacgctctcgcggcgcgcggtccggcacctcgaagccgggctgggggcgcaggcggccgccgaccgcgccatcgaggagttcagcgaactcacgggggcgtcagccggcgtcattgtcgtggaccgcgacggcgggtgcggcacagcacacaacgccgccgcgatgcagaccgcacggcactga

SEQ ID NO: 1606 - protein, 294 aa, Halobacterium sp. NRC-1
MRVLVHGGAGAPPDAPAPRQDTLETAADTGASHATPVDAVTAAVRVLERDPAFNAGTGATPQSDGVIRTDAGMMTSDRAAGAAASMPGVEAAVAVARAVMADTPHVLLSGVHAVDFAADTGIPVESDLWTADTRARWDDLDSHPDGSPTDHRDWVRERFGRTDPGGRESPPGDHDTVGAVASDGDRFATATSTGGRWLALAGRVGDVPQIGAGFYAAPAGAASATGAGEAIAKTTLSRRAVRHLEAGLGAQAAADRAIEEFSELTGASAGVIVVDRDGGCGTAHNAAAMQTARH

SEQ ID NO: 1607 - DNA, 885 bp, Caulobacter crescentus
  CDS (1)..(885)
atgaccgatgtcccctatgtaatcgctctgcatggcggggcgggcgtgatcccgggacgggactatggtcgcgcgctcgaccatcttcgcgatcttgcggcgcggatgtcatccaagctcgcggacgggctcgacgcgatcgacgcggtcgagatcgccgtgacggaaatggaggacagcggcctctatgttgctgggcgcggctcggccccgaacgctgtgggcgtggtcgaaatggatgcctcgatcatggacggggcgcgccaccgcgcgggggcggtctgcgccatacagggcgtcgccagtccagtgggcgcggcgcgccaggtgcttgaggccacgccgcacgttctcctggccggagaaggcgccagtcagttcgcgcgcgcgcgcggcctgccgctgatcggggatcccgcaaacttctaccgcacgcctgtcggcctcactcaggccgacatcgacgccgaggccgccgccttggcgcacggcacggtgggcgccgtggcgctcgaccggcggggagccctggccgcggcgacgtcgacgggcggtgtcttcggaaagcggcccggacgagtaggcgacaccccactgcccggcgcgggcgtatgggctgacggcgaagtcgccgtgtcctgcaccggggtcggcgagtacttcattctcggcgcgacggcgtatgacgtcgccgcccgccttcgctacgcgggacaatccctcgaccaagcctgccagggcgccatagcccggatcggcgaactgggcggggatggtggcctgatcgccgtggaccggcgcggccgtgtgagcttccagttcaattcaccgggcctgaagcgcgcggtggctggctgcgggcgcctcacgcaagcgctgatttag

SEQ ID NO: 1608 - protein, 294 aa, Caulobacter crescentus
MTDVPYVIALHGGAGVIPGRDYGRALDHLRDLAARMSSKLADGLDAIDAVEIAVTEMEDSGLYVAGRGSAPNAVGVVEMDASIMDGARHRAGAVCAIQGVASPVGAARQVLEATPHVLLAGEGASQFARARGLPLIGDPANFYRTPVGLTQADIDAEAAALAHGTVGAVALDRRGALAAATSTGGVFGKRPGRVGDTPLPGAGVWADGEVAVSCTGVGEYFILGATAYDVAARLRYAGQSLDQACQGAIARIGELGGDGGLIAVDRRGRVSFQFNSPGLKRAVAGCGRLTQALI

SEQ ID NO: 1609 - DNA, 984 bp, Caulobacter crescentus
  CDS (1)..(984)
atgatgggcgccaaggcggcgttcgccgccgacggggccgtccgattgcagggcgccggcgtgatctcgacctgggacttcggcgtggcggccaaccaggccgcttgggccgtcctgtccaagggcggccgggcgctggacgccgtcgaggcgggcgcgcgggttcccgagcaggatctgaagaaccacagcgtcggccgcgccggctatccggatcgggacggaaacgtctcgctggacgcctgcatcatggacgagctgggcaactgcggcgcggtggcggcgctggagcatatcgcgcacccgatctcggtggcgcgccgcgtgatggaaaagactccgcacgtcatgctggtcggcgccggcgcgctgcagttcgcgctggagcagggctttccccgcgaggaactgctgacgcctgagtcccgcgccgcctgggaggcctggaaaaaggacgccaagtacgatcccaaagccaacagcgaggtcttggactacggcaagaccacggggcaactcggcacgccgggcggggcgggcaaccacgacaccatcggcatgctggcgatcgacgccaagggaaacctgtccggcgcctgcaccaccagcggcatggcctggaagatgcgcggccgggtcggcgacagcccaatcatcggcgcgggcctctatgtcgacaacgacgtgggcggcgcgacctctaccggtgtcggcgaagaagtgatccgcaatgtcggcagcttcctggtggtggaactgatgcgccagggacgctcgcctgaggcggcctgccgtgaggccgtcgagcggatcttgaagaaaaagccccaagccaaggacatccaggttggtttcctggccgtaaacaaggcgggcgaggtcggagcctgggcgatccagtccgggttcagctacgcggtgtgcgacggtcgcaaacaggacctgctcgtccccggcaaggcgacctattcggcagcccggtaa

SEQ ID NO: 1610 - protein, 327 aa, Caulobacter crescentus
MMGAKAAFAADGAVRLQGAGVISTWDFGVAANQAAWAVLSKGGRALDAVEAGARVPEQDLKNHSVGRAGYPDRDGNVSLDACIMDELGNCGAVAALEHIAHPISVARRVMEKTPHVMLVGAGALQFALEQGFPREELLTPESRAAWEAWKKDAKYDPKANSEVLDYGKTTGQLGTPGGAGNHDTIGMLAIDAKGNLSGACTTSGMAWKMRGRVGDSPIIGAGLYVDNDVGGATSTGVGEEVIRNVGSFLVVELMRQGRSPEAACREAVERILKKKPQAKDIQVGFLAVNKAGEVGAWAIQSGFSYAVCDGRKQDLLVPGKATYSAAR

SEQ ID NO: 1611 - DNA, 831 bp, Sulfolobus solfataricus
  CDS (1)..(831)
atgagatataatttaccagtactcgtagtacacggcggggcaggaagttggcaaatagctgatcaagataaggcaaaattgacaataagcgaagcgttagaaagagggtactatgaatttaggaaaggttctgcaatagaagctgtagtagaggcaatatattatatggaggagtctggggttttcgatgctggaaagggtagtgtgagaaactcagccggctatatcgaaatggatgctggaataatggtaggtaatacacttcaagtgggaggtataatggggttaagagagggcagtgcgataaaaaaggcattggaaatcctattccaaaataggcatgtattgatgataggttctaattataatagttcgaattctaataatagtgcaatttacgaaagtaaggtttctggagatactgtaggtgcagtagcattagatcagcatggtaatctagttgcaggaactagcactggaggtataaaaggaaaattaccaggtagagttggtgattcccctattccgggtgctggctattacgctacgtctaatgtggcagtttctagtactggaattggtgagataattttaaggatattacccgctaaagaagttgatattttggtctcattgggtttcactattgatgatgcactaagggcggtagtaaataaggtgactaagactttcggaaaagataatataggaatgattggattagataagtatggaaacgcctcagcttactataatacaaaaggcatggctagaggtgttatctcctctgatggagtcaagaaagtatatgtcttcgagggtgacatctaa

SEQ ID NO: 1612 - protein, 276 aa, Sulfolobus solfataricus
MRYNLPVLVVHGGAGSWQIADQDKAKLTISEALERGYYEFRKGSAIEAVVEAIYYMEESGVFDAGKGSVRNSAGYIEMDAGIMVGNTLQVGGIMGLREGSAIKKALEILFQNRHVLMIGSNYNSSNSNNSAIYESKVSGDTVGAVALDQHGNLVAGTSTGGIKGKLPGRVGDSPIPGAGYYATSNVAVSSTGIGEIILRILPAKEVDILVSLGFTIDDALRAVVNKVTKTFGKDNIGMIGLDKYGNASAYYNTKGMARGVISSDGVKKVYVFEGDI

SEQ ID NO: 1613 - DNA, 981 bp, Vibrio cholerae
  CDS (1)..(981)
atgacacagccttttgcgattgccatccatggcggtgccggcacgattttgcgtgagcagatgagtgatgcattgcgcatggacatcctcgcgacattagagcaagccgtgcgagccgggcatcagctactggttgaaggagccgatgccttagatgcggtggtggcagcggtgacagtattggaagactcgccactgtttaatgccggcaaaggctcagtactgacgcacaatgaaatggtggagatggatgcctcggtgatgcatggcgcagcccgagaggctggcgcgattgctggtgtgcgccatattcgcaacccgattcaactcgcgcgcgatgtgctgcgtcatagtgatcatgtgtttttgattggtgatggggcggagcaatttgctttccagcaagggcatgtttataccgagcaagattattttttcactgagcgccgttatgaacagctgcaaaacatgaagcagcaagatcgcttcgcactttcagaagcttcctatcaatccgagtctgctgaacaagagtcgccaagtgaatatcccgatgataagaaatttggcacggtaggcgcggtggcgttggatcaacagggcaatttggcggcggcgaccagtacgggtgggatcaccaataaacgctttggtcgcgtgggcgactcgccaatcatcggcgctggaacgttagctgaaaatggcaatgtcgccatttcatgcaccggaatgggcgagtacttcatccgttatgcggttgcaggcgatattgcggcacgcatgcgttatctcaaagaagatgtccataccgcctgtgaaaccgtggtgcaaggtgaactgaaaagcgtaggtggtgaagggggattaattgcgattgatgcgcagggtgaacttcactttgccatgaacagttctggcatgtatcgcgcggggattgatcgcgatggtcaattcagtgtgaaaatttacgctgacgaataa

SEQ ID NO: 1614 - protein, 326 aa, Vibrio cholerae
MTQPFAIAIHGGAGTILREQMSDALRMDILATLEQAVRAGHQLLVEGADALDAVVAAVTVLEDSPLFNAGKGSVLTHNEMVEMDASVMHGAAREAGAIAGVRHIRNPIQLARDVLRHSDHVFLIGDGAEQFAFQQGHVYTEQDYFFTERRYEQLQNMKQQDRFALSEASYQSESAEQESPSEYPDDKKFGTVGAVALDQQGNLAAATSTGGITNKRFGRVGDSPIIGAGTLAENGNVAISCTGMGEYFIRYAVAGDIAARMRYLKEDVHTACETVVQGELKSVGGEGGLIAIDAQGELHFAMNSSGMYRAGIDRDGQFSVKIYADE

SEQ ID NO: 1615 - DNA, 879 bp, Caulobacter crescentus
  CDS (1)..(879)
atgtcaaacaaacgttttagtctcgccctgcacggcggcgccggagccaagcgcggccacgactacggcgtcgagatcgcccatatgcgcggcctcgtcgaagccgcccgcgatcgcctggccgccggcgccggcgcgctcgacgtggcggtcgagaccgtggtcggccttgaggccagcgggctctacatcgccggcaagggcgcctcgcccaacgccgacggcgaatatgagctggacgccagcctgatggacggcgccaccctgcgcgccgggtcggtcgccgccctgcagggcttcaagagcccgatcctggccgcccgggcggtgatggagcacaccccgcacgtgatgctggccggccagggcgctatcgccttcgcccgcgagcagggcctggagaccgtcgaggatcccgacgcctggttcacccgcgccggcgccttcgaggacaaccatccgccggacgcgctgcccaccggcaccgtcggctgcgtggtccgcgacggcgaagggcgcctcgccgccgccacctccaccgccggagtgttcggcaagcggcccggccgggtgggcgacagccccatcatcggcgccggggcctgggccgacggccacgccgccgtctcttgcaccggccagggcgagtacttcatccgcgccgccgtcgccgcccagatcgcccaccgcgtccgcttcggcggcgaggccctggacgcggcggcccaggctgcgatcgacagcgtcgcggcgctgggcggtcacggcggactgatcgcggtcgatcgtgacggcaacatcgccatgcccttcgtctccagcggtctgaaacgcgccgccctgatgccggacggaaccatcgtcagcgcggcgttctag

SEQ ID NO: 1616 - protein, 292 aa, Caulobacter crescentus
MSNKRFSLALHGGAGAKRGHDYGVEIAHMRGLVEAARDRLAAGAGALDVAVETVVGLEASGLYIAGKGASPNADGEYELDASLMDGATLRAGSVAALQGFKSPILAARAVMEHTPHVMLAGQGAIAFAREQGLETVEDPDAWFTRAGAFEDNHPPDALPTGTVGCVVRDGEGRLAAATSTAGVFGKRPGRVGDSPIIGAGAWADGHAAVSCTGQGEYFIRAAVAAQIAHRVRFGGEALDAAAQAAIDSVAALGGHGGLIAVDRDGNIAMPFVSSGLKRAALMPDGTIVSAAF

SEQ ID NO: 1617 - DNA, 993 bp, Agrobacterium tumefaciens
  CDS (1)..(993)
atgattgtaagaggccctgccaaagttgggcgacgaaggagttatcaaatgacgaagatcgcactggccattcacggtggttgcggcgtgatgccggaagacagcatgacggcggcggaatgggccgcggcccgtgaagatctggcagcagcgctgcgggccggttatggcgtgctgaaggcgggcggaacagcgctcgaggccgttgaggcagcggtcgtcgtcatggaggacagcccgcacttcaatgcgggacacggggcggcgctgaacgaaaacggcattcacgaactcgatgcctcgatcatggacggggccacgctttcggcaggcgcgatcagcgcatcccgcgccattcgcaatcctgtgaaggcggcccgcgcactgatggtggatgaacgggcggtctatctcacaggagaggctgcggatcgctttgccacggagaagggtctcgccaccgaacctcagtcctatttcaccacgcaaaaacgcctcgaggcactggcagcgatgaagcgccatgcagccacaggcacggaagcgacggaaaacgaaaagcacggaaccgtcggcgcggtggcgctcgatgcggcggggcaccttgctgcggccacctcaaccggcggctataccaacaagccggatggccgggtgggcgacagccccgtgatcggcgccggcacctatgcgcgcgacggcgcctgcgcggtctccggcaccggcaagggtgagtttttcatccgttatgtcgtcggccacgagatcgcgtcacgcgtcgcctatctcggacaggatctggaaaccgccgccggcaatctcgtgcacagggacctggctccctatgatatcggtgccggtctggtcgccattgatgcgaagggcggcattaccgctccgtacaatacaccaggcatgttccgcggctgggttacggcgtctggagaggcgtttgtggccactcacgctgaagcttacgccgtcaaattataa

SEQ ID NO: 1618 - protein, 330 aa, Agrobacterium tumefaciens
MIVRGPAKVGRRRSYQMTKIALAIHGGCGVMPEDSMTAAEWAAAREDLAAALRAGYGVLKAGGTALEAVEAAVVVMEDSPHFNAGHGAALNENGIHELDASIMDGATLSAGAISASRAIRNPVKAARALMVDERAVYLTGEAADRFATEKGLATEPQSYFTTQKRLEALAAMKRHAATGTEATENEKHGTVGAVALDAAGHLAAATSTGGYTNKPDGRVGDSPVIGAGTYARDGACAVSGTGKGEFFIRYVVGHEIASRVAYLGQDLETAAGNLVHRDLAPYDIGAGLVAIDAKGGITAPYNTPGMFRGWVTASGEAFVATHAEAYAVKL

SEQ ID NO: 1619 - DNA, 1136 bp, Homo sapiens (man)
  CDS (52)..(1092)
gatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaaaaaaaaaaaaaaa

SEQ ID NO: 1620 - protein, 346 aa, Homo sapiens (man)
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTSASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 1621 - DNA, 978 bp, Lupinus angustifolius (narrow-leaved blue lupine)
  CDS (1)..(978)
atgggtggttggagtatagctctgcacggcggcgctggcgacattccattttcactgccaccggagcgccgtcagcctcgggaagaaggcctccgccactgcctccaaatcggcgttgaagctctcaaatcccaaaagcctcctttggacgttgtagaacttgttgttcgtgagttagagaatattcaacatttcaatgcgggaataggatctgtgttaacgaatagtggaacagtggaaatggaagcatcaataatggatggaaaaactatgaaatgtggagcagtttctggtctgagtacagttctgaatccaatttcactagctcgattagttatggataaaactcctcatatatatcttgctttccaaggagctcaagattttgctaaacaacaaggtgttgagactgtagattcaagtcattttattactgcagaaaatgttgaaaggctaaagctggcaatagaagccaatagggtccaggttgattatagtcaatataattatccccaacctgctcaagatgatgctgagaaggaattaccacttgcaaatggtgatagtcaaattggaactgttgggtgtgtagctgttgatagccatggaaatctagcttctgcaacatccactggtggattagttaacaaaatggttggtcgaatcggtgacacgcccctcataggtgccggaacttatgcgaatgaactttgtgcagtttctgcaacaggtaaaggtgaagcaataatatctgcgacggtagcaagggatgtggctgcactcatggagttcaaaggcctttctctcaaggaagctgctgattatgttgtacatgagcgtacaccaaaaggcactgttggtttgattgctgtgtctgctgcaggagaaattgccatgccttttaatacaacaggcatgttcagagcatctgctactgaagatggctattcagagattgcaatttggcctactacctaa

SEQ ID NO: 1622 - protein, 325 aa, Lupinus angustifolius (narrow-leaved blue lupine)
MGGWSIALHGGAGDIPFSLPPERRQPREEGLRHCLQIGVEALKSQKPPLDVVELVVRELENIQHFNAGIGSVLTNSGTVEMEASIMDGKTMKCGAVSGLSTVLNPISLARLVMDKTPHIYLAFQGAQDFAKQQGVETVDSSHFITAENVERLKLAIEANRVQVDYSQYNYPQPAQDDAEKELPLANGDSQIGTVGCVAVDSHGNLASATSTGGLVNKMVGRIGDTPLIGAGTYANELCAVSATGKGEAIISATVARDVAALMEFKGLSLKEAADYVVHERTPKGTVGLIAVSAAGEIAMPFNTTGMFRASATEDGYSEIAIWPTT

SEQ ID NO: 1623 - DNA, 948 bp, Arabidopsis thaliana (mouse-ear cress)
  CDS (1)..(948)
atggtggggtgggcgattgcgctacacggcggtgccggagacattccgatcgatctccccgacgagcgacgtatccctcgtgagagcgccctccgtcactgcctcgatcttggcatctccgccctcaaatccggcaagcctcccttggacgtcgccgaacttgtcgttcgtgaacttgagaaccacccggacttcaatgcgggtaaaggatctgtcttaactgcacaaggcactgttgaaatggaagcttccattatggacggtaaaaccaaaagatgtggagctgtctccggcttgaccactgttgttaatcccatttctttagctcgcctcgtcatggagaaaactcctcatatatatcttgcattcgatgctgctgaagcttttgcaagagcacatggtgttgagacggtagattctagccatttcataactcctgaaaacattgcaaggctaaagcaggccaaagaattcaatcgagtccagttggattacacagtccctagtccgaaagtaccggacaattgcggtgacagccaaataggaacggtcggatgtgtagctgtggacagtgctggaaatctagcttcggctacatcaacgggcggttatgtcaacaaaatggttggcagaattggggatacgccagtcattggcgcaggaacttacgctaaccacctttgtgccatctcagccacaggtaaaggagaggatatcatccgtggaaccgtggctagagacgtggctgcactcatggaatataaaggcttgtctttgactgaggcagcggcttatgttgttgaccaatctgttcccagaggaagctgtggactcgttgctgtctctgccaatggtgaagtcacaatgccgtttaacactaccggaatgttcagggcttgtgctagcgaagatggttactctgagatcgcaatctggccaaacaattga

SEQ ID NO: 1624 - protein, 315 aa, Arabidopsis thaliana (mouse-ear cress)
MVGWAIALHGGAGDIPIDLPDERRIPRESALRHCLDLGISALKSGKPPLDVAELVVRELENHPDFNAGKGSVLTAQGTVEMEASIMDGKTKRCGAVSGLTTVVNPISLARLVMEKTPHIYLAFDAAEAFARAHGVETVDSSHFITPENIARLKQAKEFNRVQLDYTVPSPKVPDNCGDSQIGTVGCVAVDSAGNLASATSTGGYVNKMVGRIGDTPVIGAGTYANHLCAISATGKGEDIIRGTVARDVAALMEYKGLSLTEAAAYVVDQSVPRGSCGLVAVSANGEVTMPFNTTGMFRACASEDGYSEIAIWPNN

SEQ ID NO: 1625 - DNA, 1023 bp, Flavobacterium meningosepticum
  CDS (1)..(1023)
atgcgtattatatataagcaacaaactatgaacaataaccgaagagattttatcaaaaaactgggaatcgcaaccgcagcaattgctatcaatccgctagaagctaaaaatttattagatacatccgagcctaaaactacgaataaaccaatcgttctttccacttggaattttggacttcatgctaatgtagaagcatggaaggttctttctaaaggagggaaggccctggatgctgtagaaaaaggagttcgtctggtagaagatgaccctacagaaagaagcgtaggctatggcggacgcccggacagagacggaagagtgactctggatgcctgtattatggacgaaaattataatataggttcagtggcatgcatggaacatatcaaaaatcctatttctgtagcccgtgctgtaatggagaaaacacctcacgtaatgttagtaggagacggagctttggaatttgctttatctcagggattcaaaaaagaaaaccttcttacggcagaatcggaaaaagaatggaaagaatggttgaaaaccagtcagtataaaccaattgtaaatatcgaaaaccatgatactattggtatgatagccttagatgcgcagggaaatctttccggagcatgtacgacgagcggaatggcttataaaatgcacggcagagtaggcgattctccaattatcggggcaggattatttgtagacaatgagattggtgcagctacagcaaccggacatggtgaagaggttatccgtactgtgggaacacatttggttgtagaattgatgaatcaaggaagaacaccacaacaagcatgtaaagaagctgtggaaagaattgtaaagattgtaaacagaagaggaaagaaccttaaagatattcaggtaggttttattgcactgaataaaaaaggcgagtatggagcttattgtattcaggacgggtttaattttgcggtgcatgaccaaaaaggaaaccgtttggagacgcctggctttgctctgaagtag

SEQ ID NO: 1626 - protein, 340 aa, Flavobacterium meningosepticum
MRIIYKQQTMNNNRRDFIKKLGIATAAIAINPLEAKNLLDTSEPKTTNKPIVLSTWNFGLHANVEAWKVLSKGGKALDAVEKGVRLVEDDPTERSVGYGGRPDRDGRVTLDACIMDENYNIGSVACMEHIKNPISVARAVMEKTPHVMLVGDGALEFALSQGFKKENLLTAESEKEWKEWLKTSQYKPIVNIENHDTIGMIALDAQGNLSGACTTSGMAYKMHGRVGDSPIIGAGLFVDNEIGAATATGHGEEVIRTVGTHLVVELMNQGRTPQQACKEAVERIVKIVNRRGKNLKDIQVGFIALNKKGEYGAYCIQDGFNFAVHDQKGNRLETPGFALK

SEQ ID NO: 1627 - DNA, 990 bp, Synechocystis sp.
  CDS (1)..(990)
atgacccccaaattaatcatccatggtggtgcgagttccctcgacgataaggggggcttggccactgtgcgccaatccctacatcaaattgtggccgcagtgtatgaaaccctaacagcggggggcagtgccatggatgcggtggtacaaggttgtgaattattggaaaatgagcctcgttttaacgctggtactggttcggtgctccagtcggatggacaagttcgcatgagtgcttctttgatggacggcgatcgccagaattttagtggggtaattaacgtttcccgcattaaaaatccgatccagatggcccaatttttgcaggggcaaacagaccggattttgtccgattatggggcggcggatttagccagggaaatgcaactgcccatttacgatcccgccacggattttcgcattcaggaatggatggaggaacggggagaagatgtgcgcaaaaaaatggctcggctaattgctgatcccaccgtgggcattgaagccagaaaaggcaccatcggcgtagtggcgttggatgctaacggcaaaattgcggccggtacttccactgggggcaaagggctagagcgcattggtcgggtgagtgattctgctatgccggcggggaactatgccacccgttttgctggggttagttgcactggagtaggggaagacattatcaatgaatgtttggccgccaaggtggtaatccgggttaaggatggccaaaatttagctcaagccatggcaaaatccatcacggaagctttggaaaataacactgacctgggggcgatcgccttggatcatcaaggccatattgcctggggaaaaacctgccctgtcctattggcggcctatcacaccggtacggcgatcggagacacgctggaattaaccgatggcgaccactacggcaacgcctcaatattaaaactgcaaaaaacagttaaaaaaatacagacaaaaacacggggaaaataa

SEQ ID NO: 1628 - protein, 329 aa, Synechocystis sp.
MTPKLIIHGGASSLDDKGGLATVRQSLHQIVAAVYETLTAGGSAMDAVVQGCELLENEPRFNAGTGSVLQSDGQVRMSASLMDGDRQNFSGVINVSRIKNPIQMAQFLQGQTDRILSDYGAADLAREMQLPIYDPATDFRIQEWMEERGEDVRKKMARLIADPTVGIEARKGTIGVVALDANGKIAAGTSTGGKGLERIGRVSDSAMPAGNYATRFAGVSCTGVGEDIINECLAAKVVIRVKDGQNLAQAMAKSITEALENNTDLGAIALDHQGHIAWGKTCPVLLAAYHTGTAIGDTLELTDGDHYGNASILKLQKTVKKIQTKTRGK

SEQ ID NO: 1629 - DNA, 1209 bp, Arabidopsis thaliana (mouse-ear cress)
  CDS (1)..(1209)
atggctggcgacggagcagatcaaagtcgacgctttttcgtggcggttcacgtcggggccggatatcatgcggcggctaacgagaaagctcttagatctgtcatgagacgcgcttgcctagctgcgtcgaccattcttcgtcaggattctggtgaatgcatagatgctgtttcagctgccattcaagtcctcgaggatgacccgagcacaaatgctggtagaggctctaatctgacagaagatggtcatgtggaatgtgatgctagtcttatggatggagattcagggatgtttggtggtgttggagcagttccaggtgtcagaaatgctatcaaaattgctgctttgttggtgaaagagcagattactggctcaactctcttaggccgtatacctcctatcgttgggttgaactttctgatttgcctccccaggttgttggttggtgagggagctcgacgttggggtaaatccaaaagtgttcttatacctggaactgtcacagaagctgatcagtggctggttacagagagagcaagaaatcagtggagaaggttcaaggccatgctttctgaggtaggggcaaagagtattctctctgctgaagaacatcccagaggaaccgagaataatgaaacatgtgaggaaaacgtatcatcctgtgcagctgcagatgaggataagatcatggacactgttggcgtaatctgtgttgacaatgaaggacacattgcgtgtgggtcctcaagtggcggtattgcaatgaagattagcggccgtgtaggtttggcggcaacatatggttctggttgctgggcatcctctaaaggaccatttggagctccatttctagttggatgttgtgtgtctggagcgggagagtatcttatgagaggttttgcagctagagagtgttgtacttcattggcactgtatatttcccttatctttcttagtttttatgcttttctcggtgctggtccagcatctgctgccatgaaggttttacgttctgtaatgcatcaagagagttcaaaaattggaacagctgataaaactgcaggaattctagtagttcaggcggatgcttctgtggttgtccctggaagtaagccggagctgaatgctgttgagatagctgctgcttactcgtcactttctttcggcgtgggatactatgggaactctatagagaagccaaaggtatag

SEQ ID NO: 1630 - protein, 402 aa, Arabidopsis thaliana (mouse-ear cress)
MAGDGADQSRRFFVAVHVGAGYHAAANEKALRSVMRRACLAASTILRQDSGECIDAVSAAIQVLEDDPSTNAGRGSNLTEDGHVECDASLMDGDSGMFGGVGAVPGVRNAIKIAALLVKEQITGSTLLGRIPPIVGLNFLICLPRLLVGEGARRWGKSKSVLIPGTVTEADQWLVTERARNQWRRFKAMLSEVGAKSILSAEEHPRGTENNETCEENVSSCAAADEDKIMDTVGVICVDNEGHIACGSSSGGIAMKISGRVGLAATYGSGCWASSKGPFGAPFLVGCCVSGAGEYLMRGFAARECCTSLALYISLIFLSFYAFLGAGPASAAMKVLRSVMHQESSKIGTADKTAGILVVQADASVVVPGSKPELNAVEIAAAYSSLSFGVGYYGNSIEKPKV

SEQ ID NO: 1631 - DNA, 1092 bp, Caenorhabditis elegans
  CDS (1)..(1092)
atgcgacggttttatatttttctccttctaattccgtatatcaatgggaccatcaatgatgacagtttgccaatggtcatcacaacatggggaagtgatggttttaaaaaagctacgaaaaatgcggtggatgccactttactgggaggtcgtatgtttggcttagtcgaaggattgtcaacttgtgaggctctccagtgcgatacaaccgttggatatggaggatcaccagatgaaaatggtgaaacctgtttagattcgctggttatcgacgcggatggaatgcgagtgggcgctgttgcaaaccttcatcgtattcgagatgccgcaagagttgcctggggtgtcatgaactttaccaaacatacattgttggttggagagtctgccactcagtttgcaaagactttgggctttaaagaagaagacttgtccaccgaggaaactaaatcttggatttcaaaatggaaaactgaaaaatgccagcctaatttttggaagaacgtgtcccccgatccttccagctcctgcggaccttataaaacaaatcctttgacaaaatcaatgcgatattattcacttgtaaatcagtctgacgaagctggatatctggttgaaaaaacaaatcatgacacaattggaatggtggtacgcgacacggaaaacatattcagcgccggaacatcatcaaatggagctagattcaaaattcccggtcgagttggtgatagtccgattccgggtgctggagcatatgcaaacaagttcggtggagccgccgcaactggtgacggtgatgtcatgatgaggtttttaccaagcttctttgctgtaacacagatggaactgggtacaaagccatcaaaagcagcttataaggcgataactcgaattctgaaagttttcccgaaattttcaggcgcagtcgttgcaatgaatgtgaaaggcagaatcggagcctcgtgtgcgaatattaataaattcggatacaatgtggcttttcaaaacggaacggtggtgacctactccataagttgtctcaaagaagttaattccttgaagtatctcaaagaaggaatcgaatttgcatga

(The sequence listing continues in the following parts.)

What is claimed:

1. A process for the production of a fine chemical, which comprises
   (a) increasing or generating the activity of a protein comprising the polypeptide of SEQ ID NO: 42011 or an enzymatically active fragment thereof, in a non-human organism or in one or more parts thereof; and
   (b) growing the organism or part thereof under conditions which permit the production of the fine chemical in said organism or part thereof;
   wherein the organism or part thereof is selected from the group consisting of a microorganism, a plant cell, a plant, a plant tissue, and one or more parts thereof; and
      wherein the fine chemical is selected from the group consisting of threonine, tryptophane, glutamate, ferulic acid, and mixtures thereof.

2. A process for the production of a fine chemical, comprising increasing or generating in an organism or a part thereof the expression of at least one nucleic acid molecule comprising a nucleic acid molecule selected from the group consisting of:
   a) a nucleic acid molecule encoding a polypeptide comprising the amino acid sequence of SEQ ID NO: 42011;
   b) a nucleic acid molecule comprising the nucleic acid molecule of SEQ ID NO: 42010;
   c) a nucleic acid molecule which encodes a polypeptide comprising a polypeptide which has at least 90% sequence identity with the amino acid sequence of SEQ ID NO: 42011 and conferring an increase in the amount of the fine chemical in the organism or part thereof;
   d) a fragment of the nucleic acid molecule of (a) having at least 500 nucleotides which confers an increase in the amount of a fine chemical in the organism or part thereof; and
   e) a nucleic acid molecule encoding a polypeptide which is isolated with the aid of monoclonal antibodies against a polypeptide encoded by one of the nucleic acid molecules of (a) or (b) and conferring an increase in the amount of the fine chemical in an organism or a part thereof; and
   f) a nucleic acid molecule encoding the polypeptide of SEQ ID NO: 42011 or an enzymatically active fragment thereof and conferring an increase in the amount of the fine chemical in an organism or a part thereof;
   wherein the organism or part thereof is selected from the group consisting of a microorganism, a plant cell, a plant, a plant tissue, and one or more parts thereof; and
      wherein the fine chemical is selected from the group consisting of threonine, tryptophane, glutamate, ferulic acid, and mixtures thereof.

3. The process of claim 1, further comprising recovering the free or bound fine chemical.

4. The process of claim 2, further comprising recovering the free or bound fine chemical.

5. The process of claim 2, wherein the expression of said nucleic acid molecule is increased or generated transiently or stably.

6. A process for the control of the production of a fine chemical comprising
   (a) increasing or generating the activity of the protein comprising the polypeptide sequence of SEQ ID NO: 42011 or an enzymatically active fragment thereof, in a non-human organism or in one or more parts thereof; and
   (b) growing the organism or part thereof under conditions which permit the production of the fine chemical in said organism or part thereof;
   wherein the organism or part thereof is selected from the group consisting of a microorganism, a plant cell, a plant, a plant tissue, and one or more parts thereof; and
      wherein the fine chemical is selected from the group consisting of threonine, tryptophane, glutamate, ferulic acid, and mixtures thereof.

7. A process for the control of the production of fine chemicals comprising
   (a) increasing or generating the activity of the protein comprising the polypeptide sequence of SEQ ID NO: 42011 or an enzymatically active fragment thereof, in a non-human organism or in one or more parts thereof; and
   (b) growing the organism under conditions which permit the production of fine chemicals in defined ratios in said organism resulting in a defined metabolic profile;
   wherein the organism or part thereof is selected from the group consisting of a microorganism, a plant cell, a plant, a plant tissue, and one or more parts thereof; and
      wherein the fine chemical is selected from the group consisting of threonine, tryptophane, glutamate, ferulic acid, and mixtures thereof.

8. A process for the control of the production of fine chemicals comprising expressing in an organism or a part thereof at least one nucleic acid molecule comprising a nucleic acid molecule selected from the group consisting of:
   a) a nucleic acid molecule encoding a polypeptide comprising the sequence of SEQ ID NO: 42011;
   b) a nucleic acid molecule comprising a nucleic acid molecule having the sequence of SEQ ID NO: 42010,
   c) a nucleic acid molecule encoding a polypeptide comprising an amino acid sequence which has at least 90% sequence identity with the amino acid sequence of SEQ ID NO: 42011 and conferring an increase in the amount of the fine chemical in an organism or a part thereof;
   d) a fragment of the nucleic acid molecule of (a) having at least 500 nucleotides which confers an increase in the amount of a fine chemical in the organism or part thereof; and e) a nucleic acid molecule encoding the polypeptide of SEQ ID NO: 42011 or an enzymatically active fragment thereof and conferring an increase or decrease in the amount of the respective fine chemical in an organism or a part thereof; and f) a nucleic acid molecule encoding a polypeptide which is isolated with the aid of monoclonal antibodies against a polypeptide encoded by one of the nucleic acid molecules of (a) or (b) and conferring an increase in the amount of the fine chemical in an organism or a part thereof;

wherein the organism or part thereof is selected from the group consisting of a microorganism, a plant cell, a plant, a plant tissue, and one or more parts thereof; and wherein the fine chemical is selected from the group consisting of threonine, tryptophan, glutamate, ferulic acid, and mixtures thereof.

9. The process of claim 6, wherein one or more fine chemicals are isolated.

10. The process of claim 6, wherein the activity of said protein is increased or generated transiently or stably.

11. A process for the production of a composition of fine chemicals comprising
(a) increasing or generating the activity of the protein comprising the polypeptide sequence of SEQ ID NO: 42011 or an enzymatically active fragment thereof, in a non-human organism or in one or more parts thereof; and
(b) growing the organism or part thereof under conditions which permit the production of a composition of fine chemicals in said organism or part thereof wherein the metabolite content is increased compared to a corresponding wild type cell, microorganism, plant cell, plant, plant tissue or one or more parts thereof;
wherein said composition is a biological composition;
wherein the organism or part thereof is selected from the group consisting of a microorganism, a plant cell, a plant, a plant tissue, and one or more parts thereof; and
wherein the fine chemical is selected from the group consisting of threonine, tryptophan, glutamate, ferulic acid, and mixtures thereof.

12. The process of claim 1, wherein the increasing or generating activity is effected by introducing and expressing in a non-human organism, in one or more parts thereof, or in a cell thereof a nucleic acid encoding the protein.

13. The process of claim 12, wherein the non-human organism or part or cell thereof is a plant or plant part or plant cell.

14. The process of claim 13, further comprising selecting a plant, plant part or plant cell comprising the nucleic acid.

15. The process of claim 2, wherein the increasing or generating expression is effected by introducing and expressing in a non-human organism, in one or more parts thereof, or in a cell thereof the nucleic acid molecule.

16. The process of claim 2, wherein the increasing or generating expression is effected by introducing and expressing in a plant or plant part or plant cell the nucleic acid molecule.

17. The process of claim 2, wherein the nucleic acid molecule encodes a polypeptide comprising an amino acid sequence which has at least 95% sequence identity with the amino acid sequence of SEQ ID NO: 42011.

18. The process of claim 2, wherein the nucleic acid molecule comprises a nucleic acid molecule having the sequence of SEQ ID NO: 42010, or wherein the nucleic acid molecule encodes a polypeptide comprising the sequence of SEQ ID NO: 42011.

19. The process of claim 8, wherein the nucleic acid molecule encoding a polypeptide comprises an amino acid sequence which has at least 95% sequence identity with the amino acid sequence of SEQ ID NO: 42011.

20. The process of claim 8, wherein the nucleic acid molecule comprises a nucleic acid molecule having the sequence of SEQ ID NO: 42010, or wherein the nucleic acid molecule encodes a polypeptide comprising the sequence of SEQ ID NO: 42011.

21. The process of claim 2, wherein the organism or part thereof is a microorganism or part thereof.

22. The process of claim 2, wherein the organism or part thereof is a plant cell, a plant, a plant tissue, or one or more parts thereof.

23. The process of claim 2, where the fine chemical is threonine.

24. The process of claim 2, where the fine chemical is tryptophane.

25. The process of claim 2, where the fine chemical is glutamate.

26. The process of claim 2, where the fine chemical is ferulic acid.

* * * * *